United States Patent 10,233,495 (METHODS AND COMPOSITIONS FOR SCREENING AND TREATING DEVELOPMENTAL DISORDERS) - sequence listing, part 177

SEQ ID NO: 1096 - DNA, 4745593 bp, Homo sapiens (residues 1,581,866-3,163,730 of 4,745,593)
  misc_feature (38284)..(88283): n is a, c, g, or t
  misc_feature (258953)..(308952): n is a, c, g, or t
  misc_feature (347264)..(447263): n is a, c, g, or t
  misc_feature (1469658)..(1519657): n is a, c, g, or t
  misc_feature (1801190)..(1851189): n is a, c, g, or t
  misc_feature (3417845)..(3467844): n is a, c, g, or t
  misc_feature (3653165)..(3703164): n is a, c, g, or t
  misc_feature (3875954)..(3925953): n is a, c, g, or t
  misc_feature (4146267)..(4196266): n is a, c, g, or t
  misc_feature (4651452)..(4701451): n is a, c, g, or t
gcacttcacctccctgggtcccgctcccccctgagcttacagtggacgaggggcaggacggggggaaggccattcggctgcccttctagcttcagaatcacccagtgaacgggtttcaaccgtagccggcaagatgcgcctctccggttttccgaggctttggaacctgcacaattgttctgcaaaagacggtggctccgcctagcattggatgggcgcttgctctgcatggtgatgccggagcgagggtcgactgtccgtatgtcgcagtcgggtggtgtgcttgcttccaagtctggagttggctggttcaagctcgttctactgagcgtttcttgcattttaaaaatgcttaaaccgctggcaactttcttctacccagcacattctctcatggaatggcagagcaagaccaactttacccgcctctcctccgtgtctcccatacgacatgaggacgtaaatcaaggtccgctaggattctaggatctctctctctctctctctctctctctctctctctctcgacggagtctctctctgtcaccaggctggagtgcagtggcgccatctcggctcattgcaacctccgactccctggttcaagcgattctcctgcctcagcctcccgagtagctgggattataggcacgcgccaccacgcccagctaatttttgtatttatagtagagacgggggtttcatcatgttggccaggatggtatcaatctcctgacctcgtgatgcacccgcctttgcctcctaaagtgttgggattacaggcttgagccaccgcgcccggccttctctctattttgtttgtttgtttgtttgtttgtttgtttactgtcattcatttagccctttccatacgcttttgaagttaaattggttctgtgattttatgattacatataatgttctagtcattcttgtacgggcattttcggcgttttcagccactggtgtatttctataggatagaggtgcaattactataggaagagcaattactccatcatagtgttcacacggtttttatatcattccattctctctcctctgttggcttattagctataactctttcttttgttactttagtaattcccttagggcttatagcaaacctttttaactgaacacagtcaaccttcaagtgatattaaacctcgccttctggccttgaagttattgctgacatgtactttgcttttacgcatgttataaacccacaacccattgttattgcttttgtttaaatggtcaaacttttacaaaagaaatttacaaaataagaaaatacctagtatagttacctatttctggtgttcttcatttcctcatgtagatctggattttcatctggtattggattccttctgcccggaagactcctttgacgtttctgtagtgtgggtcagctggtagtgaattcggtcagcttatgtaagtctctaaatgtccttacttcacttccagttttgggaatttattttttctggcagagtattctaggttaacttcctctgccctcagtaccttaaagatgttgcttctctgtctgctcccattgcattgctgctcccagtgggggccggcgagagcagaaagaaagttgatggcaattctcatctttgttcctgtgtaggtacaatgtctttttcttctggctggatttcagcaatgttattatgaggtatctagcagtggttttcttcatgtttcttgtgctttggtttcctcagctccttgggtcactggatttataattttcattatggttgggaacttttcagctattgtttcttcaaaaattggctgggaacagtggctcacaccttcaggaatcaggaggtgttgagtgaggccgggaattggagaccagcctgagcaacatactgaaaccccactcgtaataaaaataacaaagaaagaaaataaatgcttcctttcctccccgctccttttcagggactcacattactcataaattaggcctcttaaatctgccctacagttcactgataatcttttcatttaaaaaaaaatcttttgtctgtgagtttcattttgcatattttcaattattcatggttccatattccctgatcatttcttctgcaacgtctaatctgctgttaatcccatccagcgaatttatcatctctgatattttggttttgtcttgcttgcttgcttgcttgcttgcttgcttgctttctatctttctttttctttttctttttttggatggagtctcactctgtcgcccaggctggagtgcagtggcgcgatattggctcactgcaccctccgcctcctgggttcaagcgattctcctgcttcagcctccagagtagctgggactacaggtgcgtgccaggacacccaggtaattttttgtatttttagtagagacaggggtttcaccgtattagccaggatggtctcaatctcctgacctcgtgatctgcccccctcagcctcccgaagtgctgggattacaggcgtgagccattgtgcccggcctatacacaaacttttgtattagaatagaaaagttgagaaggtagttcacagaatggagtaaagaggatgaaatgggtttttggaaaccattcacattttaaagttgttttaggccaggcgcggtggttcatgcctgtaatcccagcactttgggaggccgaggtgggtggatcacgaggtcaggagatcgagaccatcctggctaacatggtgaaaccccgtctctactaaaaatacaaacaaaaaattagccaggcgtggtggcgggcacctgtagtcccagctactcaggaggctgaggcaggagaatggcgtgaacctgggaagtggagctggcagtgagccaagatcgggccactgcactctagcctgggtgacagagcgagactccgtctcaaaataaataaataaaataaaataaaataaaataaaataaaataaagttaacacccctcacccccaaagaacaatgtgtgttctccccagacatccctttattaaaatatgcagagaaagtgtaggataaaagagcatatgctaaactcctcagaatgtgtgtctggaagtggacaggggaatgggagtgggatgaacagagaaaagaaggaaagacagtaagggccttgctgagagcagccaccataatgtgccctgagctaaggtacatgattaccttcttcctgtgcacctgagatctaagagaatatattaacaaatcagggatatggaatttcaaaaacactatgggaaaacaacaaatttacccaaacagaacagtctacttaagaaaggcaggaagaggccgggcgcggtgggtcatgcctgtaatcccagcactctgggaggccgaggcgggcggatcacgaggtcaggagatcgagaccatcctggctaacatggtgaaaccccatctctactaaaaatacaaaaaaaatagccaggcgtggtggcgggtgcctttagtcccagctactcctgagattgaggcaggagaatggcatgaacctgggaggcagagcttgcagtgagccaagatcatgccactgcactccagcctgggcaacaaagtgagactccgtctcaaaaaaaaaaaaaagaaagaaaagaaaaaaaaggcaggaagagattttataaacaaagcaaaaacacagaaatcatacaatgaggtggtgggaatgagactaactatgcccatcatctccaacataacactaattactgctaattataatggatctaagtctctcatattggatagaaaaggaaatgtggactctaatggttcaatggcagaaaagggttaaatattcaaagcagtgcacattattattattattattattatttgagacagagtttcactcttgctgcccaggctggagtgcaatggtgtgatctcagctcaccacaacctccgcctcccaggttcaagcaattctcctgcctcagcctccctagtagctgggattacaggcatgtgcgaccatacccagctaattttgtatttttagtagaaacggggtttctccatgttggtcaggctggtctcgaactcctgacctcaggtgatccgcccgcctcggcctcccaaagtgctgggattacaggcatgagccactgcacccagcctattattattattattattatcattattttgagacagagtctcgctctgtcaccaggctggggtgcagtggccagatctcggctcactgcaacctctacctcccaggttcaagggattcttctgcctcagcctcccgagtagctgggactataggcacgcgccaccatgcccagctaatttttgtatttttagtagagatggggtttcaccatattggccaggctggtctcgaactcctgacctcgtgatccacccacctcgacctcccaaagtgctgagattacagatgtgaaccaccacaccgggtcaaaagcagtgcacattatctttagcaagctaacacagaaacagaaaaccaaacaccgtgtgttctcacttataactgggagctgaatgcgagaacacatggataaatggggttagggggcaaggacaacagacactggagcctgttggagggtgggggttgggaggagggagagcatcagaaagagtagctaatggatgctgggcttagtacctgagtgatgggaagatctgtgcatcaaaccaccatgacacaggtttacctgtgagacaaacctgcacatcctgcacatgtaccctgaacttaaaataaaagttggaaataaaaaatgtaaaaaggaaagaaaataaacaacaacaacaaaaagaacggtgcaaatctataccacgctcattagaaacaaaagaatgagagtgaaaacatgaatatccgacaaaagtaaacagcaaaagaacgctttatgttaactagaggagtaatatcctagcatctacctagaatcaaatggaactgtttttccctgaactggcctccttgggtggccgaccagggccaggtgaagagaagaattctgggagtgaaatgtccatttattccctcttgttttggtctctgtaaggcataagaagttaaaagcaagatctgatccctggtgttttccaggaactcaaaagaggtgtaggaggagagaagctcaattatcaccctggtctcctggagtatcccaggcacagtcccaagagttcagcttttcatactcgagttcctgggtcctgaaggcctttttggggaaagtactgatgttcgtgtcaaggttgggaagaaagggtttgggaggaaccaagcaacagggaggcaaagagaagacatcaacaagcgaggcaagaactttccacaggctcacactggatacaggaccagagacaagaagctgggtgagtttctgatattttcctacagaggtttgttatgcagttgcttcagagcctactcagaataaggctttttcaagtcagctcttttaatgtgaagccataactttgtggtattgcctgatggcaattctccactgcgagccattgctctaggtgtcttttttgtttgtcacatcttgcaaagagaacacggtgaaaatcttgactcctgttcccaagtctgtgtcttaactctttccaaggctgcacagctcggggtcaggaggcgttggcagttcagtggtagaattctcgcctcccacccgggagacctggattccatttccggcaaatgcagcgtcctgtctttgtgccctgtgggttttacatttacttactgtgccgcgctaataaagaaaaaaaaggaggggaaggggggaactactgtatagtccttgggttctttccgtagcggaatttatttttcttttatttatttatttttgtttgttcgtttgagacagagtctctgtctggccccccagattggagtgcagttgcacgatcctggctcactgcaacctccaccttccaggctcaagagattctcatgcctcagcctcccaggtagctgcgattacaggcacgtgtcaccatttcctgctagtttttgtattttcagtagagacggggtttcaccatgttggctaggctgatcttgaactactgacctcacatgatccaccagcttcggcctcccaaagtggtgggattacaggcgtgagcccgggccccggagaggaatttatctaagccgagactttgcagagactgtctttgaagcagccagtgggtctgcttggtctctgcgtttctacgtatttggccctaaaaccggcgcgacttttatcgtctctgctgtcggatccctgcaatacaaagaggtacctggtcactgattctctacttggaccttggatagaccattagaccacatctcgcgatggagtgcggctcaagaaatgacattcccggccgggcgcggtggctcacgcctgtaatcccagcactttgggaggctgaggcgggcggagcacgaggtcaggagatcgagaccatcctggctaacatggtgaaaccccgtctctactaaaaatacaaaaaattacccgggggtggtggctggcacctgtaatcccagctactcaggaggccgaggcgggagaatggcgtgaacccgggaggcggagcttgcagtgagccgagatcgcgccattgcactccagcctgggtgacagagcgagactccccgaaaggagagaagctgtggggtggggcggacacaagcagtggtggggaactggggcccagggaaaggggaggcatgtgaggaggaacccgagtgcagatgaggggagctgcggagaggggcctcggaccttcctgtcgaggaaggcccagtctttggtggtctcggcaaaatgaagaatgggcccccagtggagagcagcacgtccccaaaactcatttctatcacccctgtttgttttacactccaccaggcaaatcttccgtccacaggattctttttaatacttctctttaagcagtgtggtggggaggccatggcaatcattagctctggaggcctgaggaggacactctgaagaggaaagccccgcgatcatccggtttcacccctgttttcatctactcttttcctcagcgaagcctatatgggttcccgatgtcacatcgcagctaccgcattggagggttaagagccgctgacaaatctctttcgggaaggggtaagaagcgcagctggcccagagccatggagagagacgcaagagcagaaccgaaaatacttttctccatcttgttttctctctgctgtcggtgaacattaaccttccacacacaccgggtcaatactgccttggtctctacaggaggtttaccattttttacagttcccgtaagccatgttttcttctcgcttctacagttcttccaggattgagtttcaggagctggtcagcagtccaggctagttcaacatcctggttcaaaatcgtttgtctggttttgctactagggtgaagcttgcctcctagaccagagttaagacgtgttccctcggcttctgttttctagagagaattgatatagtttcttccttaagtgtttggttgtgaaaccatctagacctggcgctttgttctggaaggttattaattgttgcttcaatttcgttaatagatagagacctatttagtgtatctatttctccttgtagagttttggtcaactttatctttcaagtagttgatccaattcatcgaagttatcaaatttgtgagcagagaattgtgcataatagtcctctactatgcttttaatgtccacgagatcagaagtgagggtcattgttttctttctcatattagtaatttgtatcttctcattgtttcttggttcaccagctaaaggtttatcaattttatcggtcctttcaaagaacactcttcaggtttttttgacttttttctattgatttctggttttcaatttccttgatttctgctctagtgtttattgtttcttgtcttccactcactttggacttaatttgctcttgttttctttgagtttcctaaagtgtaagtttggattattgattttagatctttatttgtaatatttaatttttaaaatccatgattattttactttctgtgcagtaatttttttagtgtactataatttttgttcttgttaaaatctcagttttttgttgtgtaccaagggtacaagtgtagcattgttacatgggtatattgggtccaggtagttcgcatagtacccaatagctagtttttcaacccactctccctccctccctacctacctcatggtagtccacagtgtctatagttctcaagtttatgtccatgtgagctcaatatttaggtcccattcctaagtgagaacattcagtatttcattttctgtttccgcattagtttcttccagattatggcctcctgttctatccatgttattgcaaaagacatgatttcattcttttttatgggtgtgcagtattccatgttgtgtatgtaccacattttctttatttaatccaccattgatgggcacctagtttgactccatgtctttgctattgtgaatagcctggtgtggtgatcataggagcgcatgtgtctttttgttttaatgatttacattcctttgggtatatacccagtaatgagattactggttgaaaaacagctctgttgtaggttctttgagaaatctccaaattgctttccacagagactgaactaatttacattcactccaagtgtttatatgctttctctccacagccttatcagcatctgttggtttttgactttttaataatggccattctgagtggtgtgagatggtatctcattgtagctttgacttgcatttctctgattattagtgatgatgagcatttattcctgtgtttgctggctgcttgtatgtcttcttttaagaagtgcctgttcatgtcaccttgcccactttgtaatgggattattttttttcttgttgattttttaaagttcctaataggttttggacattagacctttgtcagattcacagtttgtgaacattttctcccattctgtaggtggtctgttgaccctgttgatggtttcttttactgtgcagaagctctctcattgaattaggtcctacttgtgaatttttgtttttgctacaattgcttttgtggacttggccataaattctttgccacgtctgatgttgagaatgatatttcctaggttttcttctacactttttctgctttgaggtcccagtatatattgtgtcattgcaaatgacaaccaaccacagactaatcattacaagccaagaaagggaacttattggtgaccaggaaaaatgtccaacaaatgaaaattagtaaaagacattcctgggtgtctttttctgtaaagtgtggggcattgttgtctatagagttcagcaaactttttctgtaaagggccagggagataggaagtattctaggcttgtgagccaagaggcaaaattaaggatattatgtaggtgcacatataaccaggaagaaggcaaatttctataccattttcattgatgagattctaaactaacaatagtaactgagtagaacttctcaggtggtaaatgttctttgcattgagagcctaggctcaactttcctaggctccctggtacagccctccctttccacccctcaggctgtttccctccctgttttcctcagaagaagagttccaaacaaaagatctactaccctgagaagcggtgaagtgctcctggggcccaccaaggccacacaagtcaaggagtggatggccttgccccagctatggctcagatcacctttgcaggatgacatcttgttgggagatggtcatcagagacagggccatggaagacgctgtcaggaggaggtgagaggactggtgcccagggggagaagtggccaagcacctctgcattcagcctcacaaaaatctcaaggggatgtagaaatggggacagggtgaatggaaaactcaagcaaggttttggggccctgagctgatctctgtttttcttcctacaacctgcagcacatgctattttctcacctctgtggatggaaacaccatccttccgtatgctcagtctaaaaatctttgagttttctttgactgctgatctttccttcacatcctatagctgtttagtcaagaattcacattatgctgggcaatcaggtgttgtccttaatcgacaccatccttttcacccccgcccccagttaataaaacttgtaaagtcattctcctgataaagacaataggatttccatgaaattgcacaattttaatccttcctggatgcatgactcaagtaagagcactgcttttgtttactaccattttcccctatttttatttcatacctgtttgacccgcactctttcccataagccaggcacttcggctcaggtgtgctttcctaattgtagaatgagcaataatagcagccttgctaacaacttcttcctggccccaccaccaggcaaatgtcataggatttaataggtaaagaatcataggattgccaggcgcagtggctcacacctgtaatcccagcacattgggaggccgaggcaggagtatcgtttgaacccgggaggcagaggttgcggtgagcctagatcatgccactgcactccagcctgggcaacaagaactaaactctgtctcaaaaaaaaaaaaaaaaaaaaaaaaaaaagaatcttaggctcgtccctattgcttggtgttataaaatgaattgttttcccctgaatttatatgttgaaagcttaacccccaacttgactgtatttagatatagagtctttaaggaggtaattaaggttaattagaccatacaagtggggccctaatctggtcagaatggtgtccatataagaagaggaagggcatcaaagaatctctctctttctccacacaggcacagaggaaaggctatgggagcacaaagcaagaaagtggccttctgcaagccaggaagagaggcctccccagaaaccaactctaccagcacattgatcttggacttttggcctctagaacattgagaaaataaaagtctgctgttaaaccacccaacctttggtatctttctatggcagcctgagctgactaacacccttggtaggtgggcagcattcaccttattgggctacatgatgagaagttaaagtaactttagcaataggcaccatttgatttcattgtatagatattgtgtcttttgcactgattttgccttttttagttgtgtgtatattgatgcctgggcctagcattacaagactagtcgaaatgggaagaaagaaaagaaagtgggaaagataccaagttccataattgcatcctctacccacatccagttcttagaatcttttccaatggagactgcaccttgtgtacactcaaattcaatctgagcgcacaatcatttagacaaccaaggcaacttttccaattttcagcatcacacgcttgggaaaacaagtatttcaatcactaatttaaatattcattgaggtaattattctgaggttgatgaaaaatatggtgtatccatgtactgttgccttctcctgggtcaagaatgttgtctttactctgctggctcacatttgaccagaaattggagtcccagcaaatcttactagccactcaggaagcctattttaagatagtcccaatctcaaacttgttctaagacttgtatgctgactgaggagaaagagcctcatgacaaaaattcaactagagctgtgggtgacagttgtgtgtctcactactggtctgggcccaggtttcccgtgagcacctaatgaatagactcaattgcagggatcgtcaagatgctcactatgtctacctcatagcctcaaaagaagtgataactaacagaatttgtgtagtatcctgaagggaaattaatccagatatagaggaaaagataaggattttttaaaacagacatgtgattcaacagttgtttaagatgcagaaagctgtaagagacagttgttcccactctaatgacaagaaaaagctgtatggtctgcaaaatcatacgtgctttgatcccaccagagagctgaagttgcaaggcccctgagtcagctgaagtccaaagcgtgagaaaaccccctatagaaggacaaacacatgaagcagttcatctttgacagataatggaaggaaaagatggcagccataaatgttcattggagaaaatcactgaagatttcatcatttcttaaaggccaagtgtgaactattgtgacagattagaaactctgagagtcccagatacatagcatggttttgcccatttgctgggtccttcctcccacgtccttagtgctgacaagacacatgtaacagggaaagaggatttctcaagcttgccacagtggcgtaggcataaaagtcatgatcacatgatcgaccaccaccagagtacaggcacaaaacctggttgcttctcacataaaacaaaaggcatctaccactgatgttggagctaggaactcgtccaacccttggccccagggatagggcaactgctgaggtagggttagacagaaaaactgtctgtattggacaaggggaggagacttgctcttgcccaagacttcccatcattgaaaggtagtgttccgctaccccaaggggatgtcacaggaacactaggacccaggtatccatggcctgaggcttgatacacattcagtgcaatcagtaatgtgagttggtttcgaccaatcatttgagttggttgcagaccctttcctctaatgaggaaaaactgtggtgtgggtacaaagtttccacgttcagaaagattggccttgtccttacagatattatattgattggatttctctcaacctccttaagttatgtttaccattattaaaattaagtgacattcacttggaagaagtggtaatacaaacaggttgtgagaatttatagtgatttttgatcccaagccttgtatcactgttgggtcttcatgtgtgtacttgaaaacaaaacatgtacaattgttgcactggtttgaagattttaatggtggaagtgacctaatcagtaatcagtactgtatctagaaacgaatcttggaaatatgtgattatgctcttttaaaatcgctgaaaagaaggctgggtgtggtggctcattcctataattccacactttgagaggctgaggtgggcagatcactgaaggccaggagttcaacatggtgagaccctgtctttactaaaaacacaaaaatcagctgggcatggtggtgcccacctgtaattccagctactcgggaggctgagcaagagaatccattgaaccttggactcgaaggtggaggctgcagtgagctgagatcctgccactgtaccccaacctgggtgacagagggagattctgtctcaaaataaataaataaaatagctgaaaagaaatgacagtgtgtttactctcactttgttcttgttttgttgtatagtatttaaataaaaggagattatttatcctcatactgaatttccaaaactgatatttgcatttagcattttgttaaatgatggagagaaaatttaattgtcttactttgaaaagtttggcataggttctgtcacacattttgttaaatgatggagagaaaatttaattgtcttactttgaaaagtttggcataggttctgtcacatttttgatgctttcgatcacagttctgtcattagaatgctggcaactagttatatgcaaggaatatcctaaccactttaatacaatggtttgaagtgctgcaggcagtaactactggacagcagatcacagtgacatgagagagagaaatagaactttctgcagtacaaatgtcctgtgaactaatccttgtgctattagcttacaggtcttagactcctgggtctgaaaaaggcacatacttctgctaaatcttgaatactgatgccaatgaatgccttgtcttcagaccctggggaagatgacaatcaaaatgaacttcttccatgagacacggaaccagaaattgaaaccattccatccctctaggcccaacaatcccacatgcacccttttccacctcatgccccctcttcctctggacagaagaggtgggcacatgagaattttaaggctggagtctgagagataagtttagttcagagactttcttttctttccctcttttcttctcttttcttttcttttccttccttccttcctctctttctttctcttttttttttttttttttttttttttttttttttggtagacacaatgtttcaccatattgcccaggctagactcaaactcctaagttcaagtgatccacccaccctggcctctcaaattcagagatttttctataaattagactttacactcagaaacacactgatgcaaggccagcaactgggcccgtgtatcagaataacagggttttcttgagcattcatctgctttttcatagaaaagtataaaaggtcatgaaaggtttttgaaactcttaccttatggttgaactgattataattaaatttgtgtataaggtttcattaaaattagctttaacattttaatacatcacacaaaggcaaaatttggttttctcttgatcaaaatgtttgtgtaatattaataaaaattattaattattttgaaaaattttttaaaaatttattttaaattttattttaaaaaataaaaattattaatattaataaaataaaatatttttgtttaccttttgcctaaatgattgactattttaaggtgacctgtgattctattttgtgatatcaagtctctcaaaactttggctaactttctaagagtaaaattttcatattgagccttttgggcctcaaattaactttttggatattaggttcttgaagtccaagagagatatattaggcttcttaggcttatttgttatgtagaattctgcaagaagcattgtcaaatctgaggtggtgtttcacttcctttgggttctattgacacagatgtgttgttaatgtgtgttccaggatagtatgagattcctagagttctgctatgctgtcagtaataattatgattattatgttaaattgtgtgtgccacagaagcaacagaattcccttgtcaactgtgtctataaccatggctgtcttaaggcttttgttatccacaattgttgttttgctttgattcttctcaaaaagtgacttataatcagttacagtccaggccttgcttctttggggaagtccacgaaaaggactcttggatgcaggtttctgataactttggagattgtgccattgaagtaaaaagaaaatttcacccagggcactaatagaaaggctgatatgttcataaagattgctagcccactatgaagcagagcaggagctgattgtatggactgaactaatggaggactgaagtaagtttttatggtctttgtttgtttgtttaaaacattgtttattcttcaaagcctggagaacttttgtcattttgagctatttatagcctgcaacaattgagtagaatagtcttctaaacagaatttgaggcatatttttctctctctgccgaatttctccagaatttgtaaactgaatattcttaactcatgatgatgtgtttgtttgcataagttcaataagattctgttttcttttataacaggacacaggtggaggaactggtaatcttctcagggctttgcctgaaatggtgttgtgaaatgttccagcaaagcccatttaggagagcctatatggacaaggattcttgctgcactttgtgtgggtaatcaggccaagtatatgggactgaagcttcttttgcaggtaggttggtcctgctgtgttttgtctttagtggaaatggggaactggagagaggaagattgtgtttcaggagaaactacagtattagatgaatgtttgattcctgggtggccatgcggtcacccatggtgtggagctgctcaggatgccccttctcctcatgacaaagccagaaagatgcatgaccagattccccatgattgaggaactgacaaatagaaagtggggactgaaatcgacccaatagtcccacatacagtgtttttggatagacttaaaaatggacccttctggtcttaaagcttgaaacttacatttgttttatctgagttccttcctcaggaaaggaccctcagcctctcaaaaagcatcatagacctgaaactcagcagatcacagcatccagacaatgacttgccagtcccttcactcatcatgagtgcttcctcacccttccctagttcctcttttcccacacacagttacgtttcttccctgctgtataaacccctcgttttagttgatcagggagattgatttgagactgatctcccatctcctcagctgcagcacccaattaaagccttcttcctcggcaatactcaatgtctcaatgattggctttctgtgagctgagcagcagggcctagacggaactcctgggctttcagtaacgatgcatgtacacttttaaacactgcaattaatgggtcatgagatattgagaaattggaatggcatcaacttggccaattctgagaaaacacactgtgcttaaatgtcagggccctgcctcctgacctcgacagtatatggttgattttgagtcatagcaggtgagtatggcctggtttcagtgttttatagaaatataaaatatggctgatcgcatttattttaaatccaacaaatctccatttctggtgagaaaatttttttaaaaccaaccaaacaaacaaacatagaagaatatgaataaaaaaataagggattccctgcttcccaatctcacttgattgctgtcttctgttatatactaagggaggaagggggcaaggtgcccaggaagtcccacgtcctgttttgataatcatctggcctccttgggcaaacagaaaacagggaaagcataaagaaaataacagaaattttgcagaaatttcatctccggtctgggcgcagtggctcacgcctgtaatcccagcactttgggagcccaaggtgggcaaatcactgaaagtcaagagttcaagaccagcctggccaacctggcaaaacctcatctccactaaatatacaaaatttaaccaggcatggtggtccacgcttgtaatcccagctactgcggattacaatcacttgaacccagcagacagaggttgcagtgaggggagatcgcccactgccactgcactgcactccagcctgagcaacagaaggagactctgtctcaatgaaaagaaagagagagaaagaaagaaagaaagaaagaaagaaagaaaagaaagaaagaaagaaagtgagggaggaagggagggaggaagggagggagagagaggaaggaaggaaggaaagaaggaaggagggaagaagggaaggagggagggagggaggaagaaaatgaaagaaagaaagagaaagggaaagaaagaaagaaaagaaagaaagagaaaaaaaaaggaaagaaagacaagaaagaaagaaagaaaaagaaagaaagaagagagacaaagaaagagagagagaaagaaagaaagaaaggaagaaagaaatttcactgtggcacaggaaactctatgaccgaggcttcaagggctcttctctggccctaaactcacagtggattttgcctcattttccgaggtgcaaatgaaatgatggaagtcgatcaaaggagagggcagagagaaagcaagaaggatggctccttcctgcaggtccaccttcctcgagtgttgcttgtgggataatagaaatgccttgacatggttgagtgggaactattgctacttattgggaattcagacgcttccggcaaacttgcacgatgaggttccatggtgtaatggtgagcactctggactctgaatccagcgatccgagttcgagtctcggtggaacctttctgtttaattaggacggcaatgttgtgttttactccctaaatggaatggggattccgctgacgttcagaaactctgcgctgtgggcctccgtgtcccttctgctcccgctgtctgagcctcgcgatgtaccccgcgctcctcgtcccctcttcgtctccctcttcggtgttcggggtcccagaaaccgggttctcgcagtggcccggaccacagggaaattgccgagtcatccagtcgggatcagcgagcctgcagggtccccttcctgggcgagcctcctggcacccagcaatcggaggcccggacacccccgccagggacccagcgacccaggaagtccccaccccctctcagagcgaccctgggcctcgggctgacaggtctcctccactaaaaaggctgctgcccctctatcctagaccccgagattcctttcactcgggaatctcctaatggcacccattgtctttttggtaagtaaacggtggcgtgagaaattctgatggggttagctcagtcattggagagtgtgtctcagtttaggatcgatggttccagacctaacttggcagtagcactgctttattcagatggcccatccgattccgaatgttaatttgctctgttcttcatattcagatttttatgccgaatttctagctcctgcgtctctattgcgggccctaaaagtcgctgtttcactaagctttggaacctgactccgggaaatctcattctttcgtcccaagatctcagccagaaagagagatccgcgcggcggcatcttcaagcgcgcgggctgggagcgcgggttctgatcctgggtcgccccggccgagctccctcagggccacggggaagaggaacctgagcagctctgaggggcgagtctctgaagatggggctcccccttctcccgtcaggaccctgccccaaggagaagacgccttagttaaaaatgttttctcctgctcttcagagcacttgggatgaggttcctgatgggtcttgggagcgaactaagatgtcactccaggcgctcaggaccatcgctctcattttcatattttggggctgagagcggttacgaaggactgaaaaataccgcagtctttgaggggctcagtttggaggacgagccggggttgaggggggttgacgccttcttggctccttggagtggactggcaggtaaggaaacacaaactccgtttccccttgcgggcagaactgcaggacctgggatggaaaattggacagtcaaagagtaacgatatttatgtagaggtgggttgcgtgcattaaaaattgttatccctacagataagtgtaggaagggaccagggcactgctgttcaccaccagctttgcagcatatgtaactttgataacagtgtatagtgcataaaaattcattcctgtttacaaatatttgatcacaaccagttacaggtttctttgttccttctccacttccactgcttcacttgactagccctataggaaaaaagaatcattcttaaatatgatattgtttcagttgatcgccagcccacccgttcccctccccctgaaagtagctgggacaacaggtgtgcaccgtgtgctgggctcatttttgtatttttagtagagatggggtttcgccatattggccaggcagctctcgaactccagaactcaagtgatccgcctgcctgggcctccctacacctccctgctgggattacaggcatgagccaccccacttggccatcatttgtattttgaatttaaatattttgtagtcatcactcttcaaagattctgggttttgctgcatgtgcatgatgggattcaggacatgctactccaaagtataacatcttggggtattgaatattttatgctaaaggaatatgagtaaaccacagaagcaggaaggtcactgtcaccctccccctgcccttcctccctgaagtccagtataagactcttatgtgagaggtgccctctctgtacccagaggaaaggtgcatccttgattctgaagacacagggacacagagaagagcctgaacacagaggcctggctacctttcccccactttgttactgttagatcatacttttattgacttatcatacttctccatgactattcattcttgaataaacctactgttaaaaaaacgaaaacaaaaactgaggtttagctgtttccatgggccttcatttcctttggaaggcgttcctgtcatgtaaaatttacattaaataaatctgtatgctcttcccttgttagtctgtgttttgctgtgagggtctcagcagcgaacctaggctgggtgaggaaaagtcatatttcctccccgacatgtacaaatgtcttccactgtaaagctatatgatttttttttttttgacagggtctcactctgttgtccaggctggagtgcaatggcacgatatcagctcactgcaacctccgcctcccgggttcaagccattttcctgcctcagcctcccaagtagctgggattacaggtgcctgccaccacgtccggctactttttgtatttttagtagagatggggtttcaccttgttggccgggctggtctcgaactcctgacctcaggtgatccgcccgcctcggcttcccaaagtgctgggattacaggcgtgagccactgcacctgggcaaaactataagaattttactggggcagatttgaagcaagaaattgaatcattattcccctttggatgagctgaacacatgagctaataaactcccagttcctcccagatagaaatacttctctagttcattccccgaagctccttgagggtcaaacctgctggagattgaggggccttcctgggatctcccagcccaggaggttactgctggtgagaagattgctgcagtctccctgggagggtgcacggccactggaaagtatcactgctgtaacttcaatacaactggttttcgtcacatctgctctttgtgcagtgttgcaggcaaaatacaagagctaacatgcacatgagtaacacatgcacatcatcagctgtgtctgcaacacaaagtgccacatgtcaggcacagttgattatgtgcatgtgtttactcatttagtccttacctcaggccgaggtcacactatcaccttcatcttccatgtgagatgcacaaagacgttaagtgacctgtccagggtcactcagccagcaaaggaggatttgaaagcaggaatttgaagtgaaggcagcctgtctccagaagacattctcagaaccactgcatttatactgctcctaacaaaaccaccgttgcaaaaattatgacagtgagaaaaacctgacataggaaaactatgactgtgaaagaaatctgacctaactgactgcatcttacttctaacctctgagctgcctttgtccgttcctgggcataggccaggctaactatgagaggagtttagttccaagtctaagtctgaaacaaagatgtcttcctgagacaaactccttcctatcttggggatcagatctccttagcaaagctaacaaattaggtgcgagattggaaattatggctcaggagccatgcagccagaagccacatgattcctaagctccccaactgtgcctgtatataagattattggtgtcaaacctaagattggtgttcaaggtatttttcagaccctgccttatgatggactagctggcacacccagaccggtaaactggctcatctggtcctgtggcccccactcagggactgactcagtgcagtaaacaagctctgacactgtgatttcatccccaacccaaccaatcagctttgcacattccctagccccttgcctgccaaactatccaaaaaaaaaaagaaaaagaaaaaagaaaaaaaaaaccctagtctttgaattttgggggaggcagatttgagtaataataaacccctgtcctggtccctcagctgcctctgcatttattaaattctttctctattttagaaagcctgctgttctcagctccattggcttacctgggcaatgggcaagataaacctaccaggcagttacattaataaaagagaaacacaaatggtaagcatgcttgaaaagaaatataagtctgtgtatttctttggaagaaacacaaaaggaggaggaatgataagacaggcaataaatacactgtcctaaatattttcatgattctcctgcctccttcgtatccttcttatcccaacaacttctccccagaaaccttcaacttaaacatggtcctgccagaactgggtttgtccttccctttacattttcctctcacctaccctacaccccttccatatctaatctgttctttaacttccaggtcattgagaattttccatttaaaaatataaaaaattcataaagcggaagataaccagtcatccatattcacacctcctggaattaactactattaacatacctacatatttttcttccaaatcattgttaaactatacatgctaagcatagaccatactaacagtagagaagatgtaaacatatgtaaaatttttgaaaaccttacgttcaaaaataacttctcataacatttgggcaaccctggagttacagtcttgtggtacatctacagggagaagaatgtatattttagctagactgtccctatccctaaaagaaaaaggaagaaaaaataataaagaaggatatatatacttgaaaaaataataaaataataaagacgcatatatgtatgcttttataaaatttagctgagactctatttttattttacaaacattccatttaatagtgcatgaacttaactgcagacaaagagacagaaacagaaacgaaggaattcctcaactcccgattacagttagagagatatttttctaaaggaatcttctaaggataaacgtacactaaattaagtagaagacattaagatttggagtggttttcttattcccttttacaatcaggttgattaaggtgtgagttgactttggtacaatgcatccatttcaagtttgatgacgtgtctattactctaaaaggtcctcttgtgccctttgcagtcagttccgccctccccctgaggccagcagtcaatgatgtagtttctgtcactatacaggttagttttaactgttgtagaaattcaccttgatggcgccacacagggtgcactcttttcatcactcggcataatgtttttgagatgatccacgctatttcatgtttccgtaatgtgtcctattttattgctgggtagttcgggtagttggggtagatcgcagcacattctggcgacaggtgagactgcggttctgacctgcaggcctcggtgaacatgagcaagggcacctgggcgccgggagagacctcccttcccctacagaaagcaagcgtgttatgttaacaaccgaacggggaccctgctttcatcccaaagaacagcacccgactgcgtagtttcttccctggctctaggaggtgagaacacattccccgctagcacagacatcctacaaactcctgcggaggctgcggttagaagcagaggctgtgtgaagggtgactctgggggctatgaaaaaacacgaaggttttcacagagcatgagaacccaaaagactggagactatgaagcgatctgcaaaaagcagccccaagtagaaagggaagagaagagccctgcggccacttagtgttaaaagagctcacggcggcggagaggataacacgttactttctgtttcccatcattgcgactgtaaggagaacacttaacatgccacccaagccacaaaactgcagttttaagaataacccttataggggagtctattttttcattacaaaaattcaggggaaagcgcggacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgacttcacacacttctgccctgtcacagctccatatacctcaccctttacacacatggtcacttgccccgcgcacccccgagccttcctagccctgacacacagctgggaccctcaggtccgaccagcggtcctgaacccgctcccacggcacgggagctccttcgtggtgaaacagccagtggcgaagcagcagcccctgcgctgcctcatctacatagaagtcgccctatccgtgatgtcaccgacagcgccttcctcgtcccggtctgcttttctgccccaccctccgccactcagccgaccaacatggtgccagagcctgcgggggcagtgatgtctgcctctgcctcctttccctctcttccccgcccatggtcttccccaaagaagcgggtgtttctgttgtagttttttgtttgttttttgttttgcgccgtctcgctctgtcgcccaggctggagtgcagtcgcatgatctcggctccctgcaacctccgcctctcgggttgaagcgattctcctgcctcaggcttccgcatagctgggattacaggcacacgccaccaagcccggctaatttttgtgtttttagtagagacggggtttcaccatgttggccaggctgatcccgaactcctgacctcaggtaatccgccgacctcggcctcccaaagtgctgagattacaggcgtgagccatcacgactgcccagaagccggttcttagcctgtgttgccgaggacctctttggcagaaatctggagcctgtccacccttcttcaaataatggcttgtaatgcgcagactaaaacatggaggattacacaagaaactggttcacttcacatcattatccttgtgatgtagcattctacttgaaattggaagccgttcgatatcagagaaaccatatctatgaaactagagaggctgctcagatgactgcaaaccagccatccttacttgttttaccactagtagtgttataaggacggtggtccaatttcaggaatcttgtagggttctttcaaatacagcaatgtacaaatatgctgccccagcagagcacactggacactcgggcatgatgctggagtttgtcatctcttccacggccttctccagaccttagcacttacctcatgttagcactttatgttctgcaaagacagaaacaaagtggtccaaatttagaaaaaatatatatatatttgggggaaactttatttgaggtgcttaacagattacttttaatctgtagaatacaacaccaaactctgacaatactccacagactccaaatctatcaggcaagtttttcctgtcctttgctttcatataaactgaatcataaagtgtatagtgggttttgggggaatataactgcccaatgggttcatgttgcctgctgcctagacagaaccaatttatcaagacaggggaattgcaataaagaaagttatttacccagagccagctgtgtgagagaccagttttattattacccaaatcagtcttcctgagtattctgggacccgaatttttaaggataatttggtggctgggggccagtgagttgggagttctgattggtcaggtcggagatgaactcaaagggagctaaagcatcctcttgagctgggtcagttcctgggtgggggccacaagatcagatgagctggtttatccatctgggtggtgccagctgatgcatcaagtgcagggctacaaaatacctcacgcactgatcttaggttttacaatagtgatgtgatccccaggcacaattcagggaggtttagaatctcataagttggaggctgcatgatcctaaaccatcatttctaatcttgtggctaatttgttagtcctgcaaaggcagtctactccccaggcaggaaggggatttgttttgggaaagggctgttatcatctttgtttcacagctaaaccataaactaagttcctctcaaagttattttggcctgtgcccaggaatgaacaaggacagcttggatgctggaagcaagacggaagcagttaggtcagatctctttcgctgtgataattctcccagttataatttttgcaaagtcggtctcaggagcagaggcataggtttgacttctttcactcagtcttacatctatgaatttttcatgttattcatgtggttatttgtttctgtgtgtattcctttgtatgaatataggccaatttatttatttattctactgttgctgaacatgttgacctaaaagaaagaggctgaagcacaaaatagaatctagagtttacttgagccaacatgaagacagctgcctggaagactcacaccaaaagaaccttggatctgagctccctttggcctttgtcacaagcaggtttttaaaggtcaaaaggggggatgcacaatgggctgacagaaaggtgcctgtcaggaattctcattggttttcagaaatagcattgatgagagcttggctatcccttgttatagggtgtgggatacagtgtttggtgtggcattattagattaatttacagctacctggggtgatagcaagcagttgcaacagatgaatacatagctcaaaaggaaggaagcagaaagtggttgctgtcttgatttaatgtctctctgatcatgtgaagtggctcacattcctcagataaaaattcttttaaaaatctttcttctttaaagcatagatgatcaaaagctcagccaaggtgtccctctttgccaggaacactcattcccggatagtctttcccacagtgagggcaggggaggaaaggagctgcctcactgaggaatttttaagagcgccccaaagcccaattgaaagtacgtcacagagtagaaaaaaaaaagaagaaaagaaaagaagagagagagacttcagttaaatctacagctgtcacttgtttaatcatctctcgtcttcagataccataaaatcagttttctcagaagtaaaacaggaaatatataacattaataatttgaatagcacagatataattcacacaagaatgagaatcacaaagagaatccgtatgccagaacagtaagggaacctattccattagggagccaacgaaaaaacatcagggaaaacatcacatcccagttcttctttcatgatttcttgtagccaaatgacttctaattttttctagatgaggttctacgtcatgggagtatttatttttgtatacgcaacaagaggttgtaaacaccacacatccacctccctgctcagctaaatctatcatctaaagcgggctgcggaggctgctgttgctggggctctccccttggtgttctgggctgcgttgtactaagtggagaaggtggttgtgggcaagcgttgtgcagagatcacaaccaggtgggcagggggctgctctctccacactatcacttgacaatgtacaattccttttatgaactcttgtaagtgctgctgtatctacccattgtttttgttttgttttgttttttgagacaggctctctctctgtctcccaggcgggagtgcagtggcacaatctcggctctctgcaacctctgcctcctgggttcaagtgattctcctgccacagcctcccaagttgctgggactacaggcacacgccactgtgtgcagctaatttttgtatttttagtagagatggggattcaccatgttggccaggctgatctcgaactcctgaactcaggtgacccacctgcctcggcctcccaaagtgctgggattacaggcatgagccaccgtgcccaggttctaaccatttttaaataagaataatattgtctttgaaaatatatatcatctaaagtaatgcaattatctagtacaatcttagccagtgaataaatagctttttgttgagctgtgaaagaggctacagtttcatcagcaatatttctttctttctttctttcttttgtctttcttctttttttttttttttaagacacagtcttgctgtgttgcccaggctagagtgcagtggtgcagtctcagctcactgcagcctcaacctccctcgctcaagcaatcctcccacctcagcctcccgagtagctgggactacagacatgcaccactatgcctggctaattttgtttttgtttgtttgattgttttgtttgtttgttgaaagacagggtctcgctatcttgctcagaatggtcacaaattcctgagctcaagcaatcctcccagctgagcctctcaaagtgctggaattacaagcataggcccccaagcctggactctttatttttctttcagagagaaggagtggctctgtcgcccaggctggagtgcactgtcgccatcataggtcactgcagcctggaactcctgggtttaagtgatccttccacctcagcctctgagtcactgggattataagccagagcccccatgcccggtttttatcagcaatgttacctaaggttaaagaaggatttcgaaccacgggaagcaacatcccatcaaagcaaaagcgtgctcccccaaaaatgtatggagctactttcttaatggtcaggcaggtaattagcaagttttctcccaataggatctccatctattaataaaatagagtggtgggcatgcctagtgaaaagtttgaggacactcatccaattcttttttttttttttgagatggagtctcgctctgtctcctaggctgaagtgcagtggcatgatcttggctcactgcaacctctgcctcgcaggttcaagtgattctcctacctcagcctcctgagtagctgggaatacatgtgaacaccaccatacccagctaatttttgtatttttagtagagacggggtttcacagtgttggccaggctggtcttgcacccctgacctcaggtggtccacccgcctcggcctccccactcatccaatgttgggtttcttcagagctatatatatatataggcatgaccaaatatcctaaaagacattgcacttcatcattccatgtctttagacatttaagggccatggatggtgatctcctccacagaccaaataaatgctggtgcacaacaggtaagtgtagtataatttgggtacatcagctttcggcatttaaaccatgcatgggtcagacatgttagagcaagagggcaggttggatcctgatagcaggagggagtgtttttctcttaactttccaatagcatcatggtgtttaccactgtcatttcagagtgaggcaacaattttttgttcgttttctttctgatctttggttttttttgcaaccggggtctcactgttgcccaggctggaatgctgtggcaacatgacagcccagtacagtcttgacctcttgaccttcagggctcaatgaatcatcctacctcagcttcccaagtgctggagttaggcacacaccaccacgcccagcttatttatttactttctgagacagggtctcactcttttgcccagtctggagtgcagtggtgtcatctggattcactgcaggctcgaactcctgggctcaagtcatcctctcaactcatactcctgagtagctgggactacagttgggtgccaccatgcacccaactgtatatttttgtatattttgtagagattgtttcaccattttgcccaggaagatagtctcaaactccagggctcaagtgatcctcctgcctcgatctcccaaagtgctgggattacaggcagttattttgacagtacaattatgatgggttaaactgagacgtacggcaggaaggttaggatgagtcagacagattcgataaacaggttttgcttgatgtaaccccgagttgcatcgtgagttcaatcaggaggaatacaggtgaaatttggcacaggatgtaccaatgggtcattatggtcaaaagtggttggtggtttaaggtggcaaacccagcaccttgtcacatttcccacagtggcaatggtttgtgagattctgatcagagaattatccctccctgatgtaatcaaattaattaaggacagtaaaacagaaatctgatcataggcattttgctatgtatgtatgtatatgtatatacatgtacgtgcaataggactagtgtgtcatatctttagagaatatacatataggctgattttaccaaaaccaataggatacgacccctacaacttaaaggagccctgatggtgtatgtattccagtcaagagaaaaagagactaactcttccaggtgcagtgagcactggaattgtgaacagctggttatacaggccagtatcttgggtggaagtgggctacaacagatgtcagctacttgccatcttcgtcaggaagatggcaggtcacctttaagtgaaaacctccactgacagatgtccactctggtagggttgccttttagatatgagaaacatgaatctgtgtgtcaatgcccttatatttactgccacagagattaggcaataatacctgatgtgagccaggtgcagtggcccacacctctggtcccagctatttgggagactgaggcaggaagatggcttgaccccaggagataaaggctacattgagtcataattacgccactgcattccggcctgggcaacagagtgagaccccatctcaaaaaaataaattaatattaataatacctacgtggtgccctccagtggacttggagggagtattttatttgatgttgtttccagtaagcgacatctccagtttataggcatagtttttgatattttcatctcccatcagctcattatgaaaggcatcctttattaatttggagctcttcataagaagttttgtgagaccttagaaataatggagaatgttacctttaagaagtgcagtgcaggttcataagccccttcatctaaccactgcatgggtcttcctgttctaatttcaaagggagggagtgaaagttttccagaaacagtgggggatctttggccagggaaggttaaaaacttctgttagctttgccaattgagtttttatcttatcattattaagttgcactagtccagaggattaggggtgataggcacaatggaaatgttgggacataggtcaaacgttacaaatggatccaactatctgactgataaggtgtgttcctcagttgctatggagatcagatggcactccccatgaggaatgattttctctaatcacagtctaccagctgcttgggctgtggctcattggcacagaaatgtttcactccagcgacagcgcgtataaattagcaccagaaagtatctgtgaccctgagatggagacagctggataaagtctaactgccatgtctcaaaaggtcctaaagatacaatgtccctgtgacacatgaaggggttttccaggattatgtttgggacagaacagaaagtacagcaagaataaaccttttgcacaatggtaggcgatgattttcaatacactgctttccccatgctatcattttgtctgaattccaacgagtcagcttatgaactactttaaaatgggtaattgaagcctaaggggtggatcagggtatcactgggcccataccatatgtgtgtttctggaaaaaacttgttccctttatctttccagagaaaataaaatattgactcaaaataaattaattaaattttaaaaagaaacagggccaaccatggtggctcatgcctgtaatctcagcacagctctttgggaggccgaagcaggaggatcacttgagctcagcagttggagaccagcctgggcaatttagtgagaccacatctctacagaattattatttttcttaatagccaagtatgatggtgcatacctgtagtcccagctacttggaaggctaaggtgggaggatcactggagcccaggaggttcaggctacagtgaactatgattgtgccactgcactgcagcctgggcaacagagaaagaccttgtctcaaaaaataaaataaaataaaatgtcttagaagtttagctgtccatcctatgcagcagaatatctatgtgtcatgtccaccatgtccttctgttgtatcatccccttagttaagccaggaaggcacctgtccccttattagaatatcatgggctcatggctagcacagtggctcacgcctgaaatcccagcactgtgggaggctgaggcacatagatctcttgagcccaggagttggagaccaacctgggcaacatagcaaggccctatctctacaaaaaaaaaaaaaaaaaaaaatagctgaatgcggtggtgcatgtctgcagatccagctactctggaggctgaggtgggaggataactagagcccagggggtggaggctgcagtgagctgagatcacgccactgccctccatcctgggtgacagagtgagacctagtctaaaaaaagcgggggaagggggagaaagtttgttgtgccagcaagtaaatgaagaaagggacagtattagagttgagaaataaattggaatatgatttgatacctctcccgcagaagataaatttgctaaaagtgctgaagttagaggcattacataagacccgttgcagttgctcatgcctgtaaatcctggcactttgcaaggccgcggagctgcttgagcccaggagtttggagaccagcctgtgcaacatggtgaaaccccttctctacaaaacaaataaaaattagcagggcatggtggcccactcctgcagtctcagctacttggaaggctgagagatgggaggatcgcttgagcctgagaagttgaggctacagtgagacgcaatcaggccactgcactccagccttagagacagaatgagaccctgtcacaaaaactaaaaataaaaattaaaaagcctgtaatatagcagtggcacatccagttctctacgctagtatagaactatcagtggccaaagatatgtgtacaagagtgatgatttcaggattctctgaaatcctaaaaccatgaagccaaccttatttcaaacacattttgaaaacggttaaataaatcatgcacaaactgactgataaaaaaatgctgttttcaaaaatgatgaagaggattattatgatgatgaatgattccactttctatccatagtattgatagagcaaccagtaaatccaggcccatcctggggataggatatctctctaggcctcctattaacaatgaaaaaattaaggttggcatataacccatccaagcctataaggggcagcatgaggattttgtcggcaccagaagtgactcgtttggtctctgtttcttgtacacaggcacaagacagcatgacatttcaggagattctctgtctgaatcggatctgtgaggcgagggtgtggggagtgtggggaatggcccttgacagggatctctgttaactgtgcctagaatcctgagaagataaaaccttccctgcagtaagcatccctggctggcctggaacctataggacttaggactatgggaagaaaaagggaagattctctagtgatcgataatacatgaacgggggagattctctagtgatcgataatacacgaacgctttaaaagctagagcaagcgtccccgggtgggctcgaaccactaacctttcagttaacagccgaacgcgctaaccgattgcgccacagagacaagaactactgcttttactgtgcgctatgggaagggcgccttcaacaaatttcccctgtgccttccagcctcagggcttgtccggcaggatgactgagcaaggccttggaaaaccggagcgattagagcggtgaatcgcgctggtcacgttggacacctgcgcgttaggagattctggagccagaaggacagccgaatggccttcgcccgccctgcccctcgcctgcttcagaagcccccggaaacgccccggtctgcgacccgggttcgagcagccagggggctcaagggaagctgaacgcctggtgggctcccgggatggctcttcccgttctttgcacagccttcacccagtgagggagcctgtgccctccctgctcagtcgcattcggggcgctgcagagcttccgctgccttcttcggatcctgcgttcggcaccggggctccaccagggcagggatcgtggtgagggtcgctcgtggatcccctcgcggggagcagggtctggcactcaccagggcgcacgactaggacttgttgaatgaatccgtcgtcgcctttatcttttagtcctttgaagagtcttgagaatggaaatcatgagagatttttccatgggggaagttctttttacgaaacgtttattcagattgatttctcggcaccccgcggggcgggcaacgggcagggcttccagtgcaccttctgcgcagtggagccgcgggggctcagctggacagtggtcgggtcgtggggctggagggcgggagcgggggaagggaaaagcaaaagcggggaaagaagccggagagcggtagaccagacatctagacctgaaaggctcgtgcggaggcagaggcgggatcttccggaggtgagaattgtttttttattgtagcagaatggggaggaattgaggggaaaacggagatagaacctgaaagagccccaaacgtgagaatctgtagctccccaagaataagatcttccagaaaaattagaccgaaaactaggcgtctgggaaccctgacatccttggaggagtagcatcatcatgaccctctgtgttccttttggcataaggacttgcttccattgtttgtttgttaaattgttgtgtttgtttaataaataaaaccttttcatgtatctttgaaattacgttggtttggccgagcgcggtggctcacgcctgtaatcccagcactctgggaagccgaggcgggcggatcacgaggtcaggagatcgagactatcctggctaacacagtgaaaccccgtctctactgaaaaatacaaaaaattagccgggcgtagtggcgggcgcccgtagtccgagctactcgggaggctgaggcaggagaatggcgtgaacctgggaggcagagcttgcagtgagccgagatcgcgccactgcactccagcctgggcgacaaagggagactctgtctcaaaaaaaaaaaaaagaaagaaagaaagaaagaaagaaagaaagaaagaaagaaagaaagaaattacgttggttctattactttatgattacaaacaatgctgcagtcatcattcttgtacacttctcattggccactggtgtatttctataggatagaggcctggagagcagctgctccagcatagtgattacatggttttttatatcattctattttctttccttttttggcttattagctataattctttcttttgttatgtcagtgatagctttaaggtttctagaatatatctttatcagtctgccctcaagtgacattataccttcccttctggcctttatgctagtgttgccatgtcatttgattttagacatgttataaaccccaacatctaagtacatacatagcgatttccagtcgtctccatttatttgtgtaggttcagatttctgtctggtatccttatccttaggcctggaggactccttcaacatttcttgtagtgtgggtcggtgaatgctttcatttatttgtatgtttttatttttatttgtatttttttaagatggagtctcactctgtcacccaggctggagtacagtggcatgatctgggctcactgcaacctccacctcctgggtaaaagtgattctcatgcctcagcctcctgagtagctgggattacaggcatgtgccacctcacctggctaatttttgtatttttagtagagacgaagttttgccatgttggccaggctggtctccaactccccgacctcaagtgatccgcccgcctcggcttcccaaagtgctgggatacatgtgtgagccactgcgcatgtgtatgtctttaaatgtccttatttcagtcacattttttagagatttttcattgtggcatagaattccaaaataactttttttctctctctcactactttatgttgccactttgatgccttgtcattgatatatcatcttttctgtttttgtaaaactggcataaaggaggcttcctgtacttgttatataatttttggaatgtgtacttaaatttaaaaaaaattgttatactttaagttctgagatacatgcgcagaacgtccaggcttgttacataggtatacatgtgccatggtggtttgctgcacccatcaacccaccatctacattaggtattcctcctaatgctatccctccctttgccccccacccccctataggccccagtgtgtgatgttcccctccatgtgtccatgtgttctcatttttcaacttccacttatgagtgagaacatgcggtgtttggttttctgttcctgtgttagtttgctgagaatgatggtttccagcttcatctatgtccctgtgaaggacatgaactccttcttttttatggctgcagagtattccatgctgtatatgtgccacattttctttatccagtctatcattgatgggcatttgggttggttccacgtctttgctactgtgaatagtgctgcaataaacatacgtgtgcatgtgtctctatagtacaatgatttataatcttttgggtatatacccagtgatgggattgctgggtcaaatggtatttctgattctagatccttgagaaatcgccacagtgtcttgcacaatggttgaactaaattaaaaatatgaaaatgggctggatgaggtggctcacgcctgtaatctgagcactttgagagggggaggcgggatgatcgattgaggcccagagttggagaccagcctggattagatagtaagactctctctctctctctctctctctgtgtatatatatatatgtgtgtgtatatatatatattaaaaatatatatatacacattctctctgtgtatatatattatatatatataatatatacacacactctctctctatagatatatgtatacacacagagagaaatacgtccatcgtgagagtcctagattcatcttaagtttcaccgaaagtgcacttagagtaaaatgtgcccactctgagggtcaaacctacctactgacgtgtaagttgtgtttgtgagacattctcaacagcatttgctttccctagcatagtggttttcatgttttcctcacacctgaatgtcctcagtgcaaaacctgtcagaattcatttcctttgctgttcttctttgagaaacctccagggttttatttatttattacataccttttaaaagcatagagacaaagactggcaagtggtatatattactacattagtcttagttctccagaaaaagaaaacgagcaggatacacacagacacacacacacacacacagagatttacattggctaatgtgattatggaagcagagaagtccaaggtctacactgagtaagctctagacccaggagagtggaatatagttctctaccaagtccaaggcccaaggcagaagactgatgtcccagctcaaagacagtggagcagagacttctttcttagcctttcattctattcaagccttctgtgggttggatgaggcccactcacactggggagggcaatctgctttactcagtttaccgattcaaatgtcaatctcatccagaaacactctcagagacacagtgagaaataatgtttaaccaaatatctgggcaccccatggcccgttcaaactgacagaaaaattcatcttcacaaatactctcaataaaagtgactaacaaatgtagcatcatgtcctgcctgtttatcccatgacaattaatgtattccagcccaacattgtcttcctttctcttacagaagcaacatgtaacagtttcattgaaagtaaggttgcccgggcacagtggctcacccctgtaatcctagcactttcggaggccgaggcgggcagatcacctgagctcaggagtttgagaccagcctggctaacatggtgaaaccccatttctactaaaaatacaaaaaattagtcgggcatggttgcgcatgcctgtaatcccagctactcgggaggctgaggcaggagaatcatgtgaacccgggaggtggagattgcagtgagccaagatcccgccattgcactccagcctgggcaacaagagtgaaactccatttcaaaaaaattaaaaataaaaataaataaatagagtgaggttaattttgaccttatggagtctctccccaacccctacatacctttgcacttgtggattgtcattttgtcatggctttgatataaaaatatatcaataagctatatgcagtgctaatgtaagtttgaatttcatcctgactccataagtcactttccattttgataaagcctagaaatattcatgtccatctccttgaatatgggtaatggatacctattgtggggcccactctcaatctcatggggttttttaattttttttaattttcattcaggtctcaatagatatgcctgggctgactgaaagccactgaaaatggcccgtggccttgtacatctgacagagtggactaaaatctaagccatggaatggggggatggaaagtgagaaacaccaaactcagcacacaatgactcagtttaaatctctgggctaagagatctatcatggcttctgggacataaggctttgtctggagggtgactgtaggctcccatgacaatgcctaccccagaaagctcaaggctgccagaggaacttactttagttccagccaatacctgctgatgatggtaggttcaggatctcccttttgtatagcacttactaagaagggaatccttcctccatccctttgagatgtgtttgtatctcctagggactccagtgtgtctttccctaggatctgaaagccattcctttgagctgtagttctcaggaaggactgagcctctgtcttccagtctctgtgggaggttagaatcctatcttctaatattgtcagctagcagacacagctggcctgatgaggcagacattcacaatgtttcacttgtgccctgccccctgccctctcccctacctccctctccccctataatgccatcacctctgtacaaatgggaacacagctcagccccgttctctactatcagtagttactgaataaaatctgttttctctgctttaactaatgtctggctttatcttcgacaaaataagtggagcgatgatttttagggacaaggcagctgcaaagagaggcacagacatgggaggagagggagggatcacctgacccttttcatttcgtaggtatctattcctgcctggtgtttataagcctgacacttggctgggcttccctggggtatatctccatggctctgtggcaagacttgaataggctggtgatgacacttgatgtccccatagccaccttcaaaaatgtcattaaaggcttgcgagaaaatgtaaggaaacacagaaaacctgattttgaaagttgccgcctctccttcttcctcattcagagcgtgtacgatattgctgtgcggtgtttgttggactgcaatttagcacaacaccttttctaatatttggcagtttcttgcagagttaagcctaccctataaggaagcaaatttactttcattcattacccatgaaaaatgaacacatacatccaataaggcttctacaaaaaatgctcatagcaaccttatttttatactaaggaaaaactgggtacaacacagtcttcatcaacagaagaatttaatacctactgttatatagtcataaaatgacctcatgcacagcaaacaaaaacaagcaaaaaaaaaaaagtaggaaaagtatgaaaaaacacagtaacatgggtaaaaccctccaaacactatacttagcaaaagttgcctataaaagtatcttttgaacatctaaaacaaatttatcttaatgtacctgtctgatactcctgtgtaattccatttatatgaagcatcaggactcaacagtggctccctctttgaggtactttgatggaaaacttcctgggttgatggaaatgttctatgtggcttggtctagttgatacttacaagggtctatacatttattaagcttcatggtacactttttacatttacatttttaatataaaaataatgttaattatttttaaactgccaaaatcccaaaatgaatacttgttttagtattggtttaaccctgagatatattttttacttatatacatactgtaaaatctgtataataaagtttggagtaaattagacctttttactcttcctacacaatgctagaagtctggaacatcttaattccatttaccctccttgtgattctcaagttactctcattaattttaaggcaccatatattttaagtcacatggacatcattatgatcattggattagtaaaacgtactatttgactgagccacacattaaacctacacatcgccctgcgttccttcgttccctttccacattccccggggatatttcacattttcgcatttcccttagttagcatgtgctgcttctccagaaaggtctgcacttcaccttcacttgaaagatctgtagtcttgggttaggagccagcagtcagttgaaaatggtagtattttagaactctatgatgtcttactttttcactgctgtgaatttagcacctgacctttggacacaataggaatttccccctctgggggctgctctggttttcccatgtgccttgggcattcagcagtgtcctgatgacatgcctcggtgtggtttgtttgtccttatgctgcttggagttcatagctcttcttgcacatgtgccttgatgcctcgttgggtttgtttctcttaattgtccataggtaagaactatttcttttcagtattgcttctgtcccattttctgtctcctccagcttccaggacattagtgacaatttattttaagcatttatgacataactcatatatatatatatatatatatatacacacacttgtttcttagttttccttcctgctagctctctctccgcttgtctggaaagtctccgcttacttatcttcaggctagtaatccatcttcacatggatccaaactgccattacaccaatctattgactttttaaaataataactattgcattttatttctaactttaatagattttctttccaattataagtatttattacatctctatgttatttctaccattaccgtattttatttgtataatttccattttatttcaaaataggttattattttctggtgaaaatttttaccgtctcttccattcttctgaacatctaaatcatatcatttgaatgttactgtcttataacctcgatgtctccatcatctgtgaaaaacctactgtttcctgttttgagtttgttttctcttgcctctgcttctttatatgcctagaatactatgactgaatggtgggtctctgtgaaaaattatgaaaggactgagtcgtgttctctgtctctgaagatgaattcccctctgcccctggcaggcaccagaggcacagatcacctcaatcccatctctgtctcggctgacctgcagcttgtttttcctcttgggaaactcagcagcaggatttttccctcagagaaacatcacatttaaagcatacatagaaaaaggtggggtttttttcataaaaagtcttagttttcttattgtaaatttaaacacatggttattactgttcttaagctaattgggctagcctgggcaacacagtgagaccccgtaactatgaaaaataaaaacactaggcaggcatggtggcatgtgcctgcagtcccagctactcaggaggctggggcaggaggagcacttgagtccaggggttcaaggcagcagtgagctagatcatgccactgcactccagcctgggtgaggaatagagaccccgtctctgaaaattaataataatcatatagtaataataagacaattggggcagtacctcctttatattgatcagatactcgatttgtctataccctccagaggaagacaaagtattctactttgtttcctgagaaaatactgtgtatttatatatgaaaaaaatccattaaaatactgggcattctaaagcatctaaatgtcataagtaatatcatttaaagtggaaacagaggcagtggtgtctatcaaggatgcttatcagtgagggaaacaaaaggaatcattaagcacccttggatacctggagggcccctctgccaaaaatctcagtaattctgtgatacacttttgagtctagcaggttattctcttttccagagtacgaagttgccaacctaaaagaacaaccaagagagagtggttctccaaagaagtgaatgtttgggaataaacagaggatttcaatccaggatatgcgcactatcgtatgaggacccaaaggcacaaccaggcaggctgagaaggggaacctttaacagcgaaaatgaggaaggttacatagttgttttgaaacaattatccttggccacaaggaataatcacaagggtggcatcagtccaaggatgaataggcagttgctgggcagatgtcgttgcagagagattctttgggtaaggttgtggtggcctttgtgcaaagttgtggttttcagagagttcttgtaatagtttttatcacaggcatgtgtgtgtgagcacccctcctttatgatctcctgattgaattttgttaggatttggcatacgtgactccatttttcattctgacaacttttacaggtcattgcttttcatccatttttactaagggctggacttgcttaaattccaggaaattatgaggtcttgatttgtataattatcacaagtgctcatgttgctgactcagttgcctatttgggatgttataattgtcttttttctccttcctgtgctgtaatttacacaatccttagaggagattaatttgatacttttcagctgtgaaaaacttgaatatgccaatcaaagaaaggttcccctcacatgctaggaatttagtttctttcctgtgctaagatccatttaggtatagcactttcctggagccaagagttcttatgaaatggggtgtggcatattgtgtattaagatcatccttattacagagatgccattcttgcagatattgacagctaatgtgtccctaagacttttaccaaacatcagatagacaagatatgaaaaccttctcattgctgcagtctcaaatgtcaggaaagaccagaatctttaggataatggacaatcaagaaagactcacagactagattagctgtcatgtactgccaatcagggaatggatccttgtcaaccaccacctaacagagattgtccccagaagttcactccataacatcaaaaccagaaacccacattggtgccactgatgacagaaaataataatgcaaaaatgagaaagaaacagtgagagagagagagagagagagagagaagacatagagggagacagagacatgtactacagccatacttagtgattaaaagccaaagagctcaatttctattcatgatattcattaaaagaagcaaggaaacaggagctaatagctctgagggttcaggtctacacaagatgcctgttgggtggagggttctgttggctccagtgatgtttctcagatgtgctaattgttatggacatagcccctgaaaaaacctatcaaataataatacagggacagctatctgcatgctaatttaccattgtataggagggagaaagggcattagattggttttggcaaataaaagaaaaaccaagatttatgaagaaaagaggaaaggggagaagaaaaaaattgcctgggacctttgtgattttgctccccttgtgtaagggacttgacagaaagctttccaagaggtcgctgtggcccatcttctctggaccagtgtgacttggtcatcacagaaaacaatcacggatgttggaggactttaaaatatcttagaagtttagcagttcatcctatgtcacagagtttctgtgtgcgatgtccaccatgtccttctgttgtacaacccctcagttaagccaggagggtgcctctcccctcacgaccagcctgggcaacacggcgaaatcccgtctctacaaaaaatacaaaaattagcccatcgtgtggcgcacgcctgtagtcccagctccttggggtgctgaggcaagaaaatcgctcggccccaggaggtcgaggctgcagtgagccatgtttgcactactgcatgccaacctgggtgaccaaggctggaatatcatacatccatgtgtagaaagtttgttgtgccggcaagtaaatgacaaaggggacattaacagaactgagaaacaaattggaatacgatttggtaccgctcccacgaaagataaatttgcagaatgtactcaaattggaaacattaaataaattctataatgtaaaattagcacatcctgttgtccacactatagaaatatctgcacaagtgaccgaagatatgtgtacaagaatgatggtgattgcagcatcatttgtaatcctaaaactatgaaacgcacctcacttcaaaaacattttgaaaagggttaaataaatcatgcacaaactcaagaagaaatgctgttctcacaaacactggcgatgatcaccatgaggatgactgattccactggtcacattattgatagagcaatcagtaaacccaggcacatcctggggataggatactactgtaataggcctcctattattaaacatgaaaaacttgaagcacaaaatgtccacctaactgacccaagtcatgggagcaaggaagatttttatcacaccacaggtgagatcctttctaaggtctatgggattcctgagtttgataggtataacgcgcggtggcccttgccaagcctcagacttaaggtggataggaagtggggacatgtgtgtctggtgatcaatcaggagttggttgtcccatcaacagaaacaggttaaaataaagccccagggccccggctggaactaccaacctttctattaacagcagaatgctctaacgaattgcgctgcaggtacacgttccgtgccttcttctgggtgctataggaagggtgcactcagcaaactccccatcccctcaatcttcaggggccctcctggcaggacgactgtgcaagttccaggtccttggaaaaccggagagattagagcggtgaattgtagtgttggacacctgcgcgttgggatattctagagcacgaaggacagccgaatggccttcgcccgccctgcccctcgcctgcttcagaagcccgaggaaacgcccccgtcagcgacccgagccgccgcctccaggctcaggggaagctgaacgcccggtgggctcctgggatgcatcttcgcgttctttgcgccgccttcacccactgagggagcctgtgcccaccctgcccagtcgctttcggggccgctgcggagcttccgctgccatcttcggatcctgtgtcccgcacgggggctccaccagggcagggatgatggtgagggtcgctcgtgggtcccctcgcgggaaacagggtatggcactcaccagagcgcacgactaggacttgaattaatccatcgtcgcattcagtttttagtcttttgaagagctctgaaaatagaaatcatgaactgtttttccatggggaagttttgttttgttctgtttgtgagacagggtctcacttggtagcccaggctggagtgcagtgatgcaaacacggctcactgcagcctcgacctcctggggccgagcgattttcttgcctcagcgccccaaggagctgggactacaggcgtgcgccacacgatgggctaatttttgtattttttgtagagacgggatttcaccgtgttgcccaggctggtcgcgaagggaaagtaagttttttttttttttttttttgatacagggtctcgctctgtcgcccaggctggagtgcagtggcgcgaactcggcccactgcaagctccgcctccggggttcacgccatttcctggctcagcctccccagtagctgggactacaggcgcccgccacaactcccggctaattttttttctctttctttctttctttctttcttactttctttctttctttctttctttttagtagatacggggtttcaccgtgttggccaggatggtctcgatctcctgacctcgtgatccgcctgcctcggcctcccaaagtgctgggattacaggcgtgagccaccgcgcccggcggtaaattctttttaaaaagcgtttattccgatggatttcctggcatcccgtggggcggacaacgggctgaggcctccagtaaaccttctgcgcgatggagctgcgggggctcagctgcgctgtttttgggtgggtgcctggggcactagggcgggagcggggcactgggtgggtccaacgggtaactgcaaggaggagagcaaggaagtcggcagaggcggcgaccctggcgaggaaacttcccagtagctttgttcagcggtaaggaccggatccctgagagacaaaaatcatcttttctactgtagcagagtggggagaacgccaggaaaaatggagagacaccaagaaagaaggaaaatcatggggacccttaggccgaagcagccctatattaagtttaaagaagaaagcaggcggcttcctgtgatggtatattggttagtactctgcatcgcggccaagggtggaatcccagtcatggcagtgtccctcctggggcgtggcactcctcctttcctttagactccaacctctgcctaggctgcgcttttacctgcgactagagaggttacaacttaccagtgccttcggagctctgtgcagtggtgagaatagaaggaacccctaccttgcatgctggggtccagtcatcttgaaaggctgggcttttgccccctctctgagcaagtgcagcacccaaaaggtgaggtgctccctctcagtcagccttattggaatcctccactattaccacgatgtggccataaccgtttttctggttcagatatttcaatcatccgtggggccttttaaggccgaatcagaaacaagcgagaggacatgaggatagtttgcactccaactgggaattttaagtaaagcctaaagaatacaataaaatctaaacttaatgtcattccccaacacccaattgttatttgtttttatttatttatttgtttatgtatttttgctatcagtaaatgactgaagtataatccacacagaccaaagtgttccaatctgaagtgcacagcccagtgcattttgacgtaagaaaccatcacccagatcaagttatgggacattttcaccagcccaaaaagtcatcagagcccctttccagtcagtcctcaccccatccccacttaggcaatcaccattctgatttctatctccatgggttacttttgcttcttcttgaaattcacgtaaaggaatatactgattctgtttcttttttgaatgcaacaatggttttgagatacattcattttatggcatgtatctcaacgttttgatgttattgatgaatacaataccattgatggaagattggaatatttctacttttggctattgtgaataaggtgtttatgggcctttttatggacctgtgccttcatttctcttgagtataaacctggtaatggaatggccaggtcatggagcaggcatatttttaactttattagaaactatcagacactcttttagaatggttgcaccatcatattctcttgccagcaacaagggatacatttgctccgcactcttataagctagtggttttccctgtctcttaaatgttgcccgttctgatgggcgtgtaatggtgtatcacggcattttaaatttgtgttttctgaatgagtgacgatgctgataattctttcttttgacatttggacatgaagaaatcctcttttgtgaacaaacactgttcaagtgttttgttcattttaaattggcttgactctttcccctcacccatttttacataaactttactgttagaatagaaaaattgagaagctagtacacagaatggagtaaagaggctggaatgggtttggggaaccaactcacattttatggttaacacattgttcaagaacaatgtatgttttccaaagacatccccttattgaaatacgcagagaaagtgtgggataaaagagcgtatactaaacatctcagaacgagtttctggaagtggacaagggaatgggaatgcgataaacagagaaaaggagagacagttaagggccttgctcagagcagccaccataatgtgccctgtgctaaggacatggaattttgaaaacagaaagttcacccagacagaccagtctagataagaaaggcaggaagagactttaaaaaacaaagcaaaaacagagaaatcatacaatgagatgctgggaatgagactatgcccatcatctccaacataacactaattactgctaattgtaatgaatctaaatctctcagattggatagaaaaggaaatgctggctctaacagtttaatggacagaaaagggttaaatattaaaagcagtgcttattatccttagcaaactaatgcaggatcagaaaaccaaataccacatgttctcacttataagcgggagctgaatgatgagaacatgtggacagataggatgggggtggggacagcacacactggagcctgccagaaggtggggctgggaagagggagagcatcagaaagaggagctaatggaaggtgggcttagtacctgggtgatgggatgatccgtgcagcaaaccaccatgacacacatttacctatggaacaaacctgcacatcctgcacatgtacccctaaatttaaagtaaaactggaagtaaaacatttaaaaagaaaagaaaacaaacaacaacaataacaacaaaaagagtggtgcaaatctgtaccaggcttattggaaacaaaagaatgagagtgaaaacatgggtatcagacaaaggcaaacagcaaaacaatgctttatattagctaaaggagtaatatcctagcatctaactaaagtcgaatggaatcgaatggaactgtttttccctgaactggcctccttgggtggccaaccagggcatggtgaagggaaaaaatcttggagtgcaatgtccatttctttgctcttgttttggtctctgtaaggcataagaagttaaaaagcaagatctgatcttcggagttttccaggaattcgaaataggtatatgaggaaagaagctcaattatcacccaggtctccgggagtattccaggtatagtgccaagagtccagctttccgaaccggggtccctgggttctgaaggcctttttggggaaagtactgatgtttttgtcaaggttggggggaaagggtttggaaggccccaacacccaccactggtcacacacatactggctgaattccagactatgctggctggtctcaaactcccaacctcaggtgatctgcccgcttcagcctcccaaagtgctgagattataggtgtgagccactgcacccagacccagctaatttttttttttttcttttttttttttggagacaagactttcactcttgttgcccaggctggagtgcagtagtgcgatcttggctcactgcaatctccaccttccaggttcaagcaattcttctgcgtcagcctcccgagtagctgggattacaggcatgcgccaccatacctggctaattttgtatttttagtacagacggggtttcaccatgttgatcaggttggtcttgaactcctgacctcgagtgatctgcctgcctcggcctcccaaagtgctgggattacaggcatgagccactgcacccagcctgttttcaaggtttttatgaacactggtacctccatcattttcaacaggtacaaaaagcagaaagtggcaagaagaaaaagcctacagttaagtttccttcattcaacaaatactaattgagtatctactatgtaccaaggcactgtcctaacacttatgaaaaagaaaacatcaataataagagtggtgaggaaataagaaatttaaagacatataggaattgtctaaaggccaagtaaatctttgtcttttagactaaaaggctgtgctaaagtagtgaataataagcaagaaaaaaaaaagaagagtgaatgataaaacagaaaaatgttttcctgtatgactagaggtcattcttaatgaggacaatacaatcatctaggggatagttgggacatctatggaagtgctttggttgtcacagcagttaagaagtgcttctcactattcacaatagcaaagacatggaataaacccaaatgcccatcagtgagagactagataaagaaaatgtggtacatatacaccatggaataccattcagccataaaaaggacgagtgattactttgcagggatgtggatggagctggaagccgttatcctcagcaaactaacataggaacagaaaaccacacatcacacgttctcatttgtaagtaggggctaaatgaggaggacacatggtggggaacaacacacactggggcctgttgagggagcctcaggaagaatatctaatggatgctgggcttaatagctaggtgatgagttgatctgtgcagccaaccaccatggcacaggtttgcctacataacaaaacctgcacatcctgcacatgtgccccgggacttaaaataaaagttgcagaaaaaaaaaaaagtgttactgacattcagttggcagaggccaggaaagcataggcaagtccagcacaaagaaaaaatgtctttattctcaaacttccttatgaatagttaactggattttaaaaatctgtataattaccaaagcctagaacctaattacattctacgtataagcaccaagtccttctgcataattttatttatttatttatttatttttgagacagggtctcactctgtcacccaggctggagtgcagcggtgtgatcacggttcactacagccttgacctcttgggctcaggtaatcctcccacctcagcctcccaggtagctgggacttcaggcacgtgccaccaagcccggctaatttttaaaaaaattttttgtagagacagggttttaccatgttgcccaggctggtctccaactcctgggctcaagtgatccaaccgccttggtatcccaaagtgctgggattacaggcgtaagccaccgtgcccagtccataattttaatatgtactaaatgtccagaaaagcaactgctgaataaagtaagagaaaactgtactttggggcagatgcagtggctcacgtttgtaatctcagcactttgggaggccaaggaggaggacagcttgagacaaattcaaaaccagcctgggcaactaagtgagaccccatcactaccaaaaaaaaaaaaaaaaaaaagaagaagaaagaagttgtacttgagttttatttgtacatttgcaaagaattgttcactgtactggtttgcttctcctggtatttaagttgcaaataccctcatagcagtctactcaggtagctgtcatgtcaagctaatctgtcagaaatattttctatttatcctttatcttactgcaagataatttttttaattatatatgtagggccgggtgtggtggctcacgcccataaccccagcactttgggaggccgaggcgggcgcacttgaggccaggagttcgagaccagcctggccaacatggtgaaaccctgtctctacaaagaataaataataatacaaaaaaattagccaggtgtggtgatgcacgcttgcaatctcagctacttggaaggctgaggcacgagcatcgcttgaagcacccaggaggcagaggatacagtgagccaagatcacgccactgcactgcagcctggttgacagagattctgtctcacaaaaaaaaaaaaaaatatatatatatatatatatatatatatatatatatatatatacacacacacacacacacacatatatgtagaaaagctgtattacctgtggatttcatttcactaaagagagtatttcaaaatacttataagaagagggcactgaatctgagaggtctgagaattaacgggctagaagatcagcatcattgtaggatacctgcaggtctcagttaatccagcaaaaggtaagaaagagcatgtaactataactgttttttcttttgagaatgtaaattctaagcatggtgaaaggtaagcaaaatgaaacttctggaagatggtactatgggttaaaagtctatccaaatctgtacaacatcaaagtgagtggcaaggaggtaaacattaccttgtctactaagaagtttcctgtgacacttgttcaaattatcaaggagagagattaatctgtcctaacagattttcaaggaagacaaaactaactggtctggccaggcgtggtggctaacacctgtaatcccagcactttggaaggccgaggcaggcgcatcacttgcaaggtcaggagtttgagaccagcctggccaacatggtgaaaccccgcctctactaaaaatacaaaaattagccaggtgtggtggcgcacacccataatctcagttactcgggaggctgaggcacaagaattgcttgaacatgggaggcggaggttgcagtgagccaagattgcaccactgcactccagcctgggtgacagagtgaggcttcaggtctcagaaaaaaacaaaaaacaaaatctaactggtctgttttgggaaaagagtcaccaacagtctacttatcatacaagaaaagtatgcctggtttaaaaatcactggtgccaactcacttcttcttttaatttttttttaagagatggggtttcgccatatcacccaggctggtctcaaactcctgagctcaagttacccacccacctcagcctcccaaagtgctgggattacaggtgttagccaccatacctgtcctacttctaactgatatacatgcatctggggacctctgagaaactctgaacagcaaacaattgaaaaaagaaatttctaaaaaagaataatttttcagcacctaaacttctgtatgtgaaactataacaacaacctaaaatgcttctaatacggtaatggccctatttctctgcaaataaggattgctcatgattcttacactgcctttcaattaggattatacagctccattcctcattcaagcttccaatacgtgcacctaagtatcattttacaatgggatatacttaggtaaactgagacggtcagatgactcagcgagaagtcacccgaagaattttagaacaaagattaataactccaatataccctctcaaccaagaatttgaagaaactaaaaggttaaacacaaaatttctggagcttatgaaacttctgagaggtataagagaaacacagaaagtaaaactaaaagttaggcttgttgtctgcttttcattttgttttcaaactgggatttccagctgtcttactaaattacatgcagtgtttctatctcaattaattcccaactgacaaaaaaatgtggatagttttcttttataagttgctcttacagtatgtaacttgagaggggtaatccaattcctctggtctcagtaattccaaagacagaaagtaactccaatagatactgctataatggaattgcagccactaactgagccctagttcctgttctaaaccctctctcccatcagaggtttgcctaaaattatacggtctcaattttcttactgaaaattcactgggatcccaaaattaaaaatcaaacctacaccaaaacaaaaccttaaacacaattagcacaagatgacaccgactatccctctatctatcccagggtttctcaacctcagccctcttacctttttgggcccaatataattctttgttttgaggggtctatcctgtgcactgcagcatgttcagcagcatctctggcctccacccactgcatgacagtagcaaccctcctctagcccctagttacaaaaatcaaaaatgtctacaggctgggtgtggtggctcacacctaccatcccagtactttgggaggccgaagcaggactgcttgaggccaggagtttgacaccagcctaggcaacacagtgagactctgtctctacaaaaaattaaaaaattagccgggtgtggtggtacagctagttgggaggctgaggtgggaggattgcttgagcccaggaggtggaagccgcagtgagccgtgatcacgccactgcactccaacctgggcaacaaagtcagactctgtctccaaaaaaaagataaaaaattgtctacagactttgccaaatgttccctgggaaacaaaactacctgaaattgaaaaccactgctctaggctatctcatttattgctcagcaggctgtgaagagatccaacctggccaacatggtgaaaccctcgtctctactaaaaatacaaaaattagccaggcatggtggcaggcgcctgtaatcccagctacttgggaggctgaggcaggagaatcacttgaaactgtaaggcagaggatgcagtgagccaagatcgtgctactgcactccagcctgggtgaaagagggaaactctgttaaaaaaaaaaaaaaaaaaaaaaaagaggcaactaaacataaagaaatacaaagtgttagcacatctagttggtacttcccccgaaaatacaaaaaaatttcttctgcagtgagttcaattttcagatttttttcttccttatactgaaaaagtcccacaaatttccccaatatatacatttatatttatcagtagaattacaaggataaactagcctctacctataagaatacatatttatttctagatattgcagtgaatatacgtacttcactgtacgttcaaatttcacatggtagcacctacattttgtaccactgtagccttttaaagatgtcaaaacactgaagtcatcactttttaaatataattactgggtgttcaattcatatcaatcattcaattaaaaaatatttaattagcaactgctatatagcaccagatagacatctctctgggacctttctaagaatcatgcaacttagaaaggtcagttgagcttaaacggtcacaaagtctttaagaaatctgctttttagctacttttattatgggtggtttgaacattttcctgtattagagttattgcaagtacaatacaatgatgaatgccttctctagcacctggtagagccaaactagataacattacttattgataaggaaaacattttattagatcaaagaagatgataaaataagtagagggagagaagcctactacatagtttcttcaggtggagcctgaaagcgagcagtccttaacctgatctcttcatctggatttaggaagataccctgatctccataaaatacttaagaaccaccctagtctcatcaataccaaaagtaggttactctgcatatgatttatctcacctgtttaatgatgactctaccagatttaatcacataaggtaacattccctgaccttgatttaatggggaaagacggatggtagggtgtaggaatggaataacacctttacactccatgacacagccctctgtggtgtactacccagtcattcatcatcaatgtggcatactaactccattagtcttggcttcacattgtctctcaataagataggtaaggtaggagtttctgctatggttttgaaaataataatctgaagttactttaagtatttattctataatctgatgaccaaaaaatctacaatggcattttacccaatcctacagaaacttaaaatcctgaggctccagactatataatcgaaatctctgattttaaaatccaagtttagtactcacaaaattttactaaagttattttcactgtaaataggaaaacacttttaataaggagaaagaaattcctaaaccaatactcacttggaatggagacttttttgaaacctaacagaaaacaatgccactaaatatgttttcattttaaaattcccttcatgatttctccttatttcttaatgtcctctttccaaatgaaccttttgtcctctttttgaatggtttttttttttttttgagatggagtctcgctctttttgcgagtgcaatggcacgatctcagctcactgcaagctccgcctcctgggttttcaagcgattctcctgcctcagcctcccgagcccagctcaaatcactaaattgcttagattagaggcgcccaccaccacgccaggctaatttttgtatttttagtagagacaggggtttcaccatgttggccaggctggttttgaagtcctgacctcaggtgatccgcccaccttggcctcccaaagtgctaggattacaggcactagtcaccatgcccggccctcttttgtcctcttatctgagtggatccaacccaaagacacacaaagctaaaattgatcaggattagcagtaaggagtgttattctgtcaaattaaatgaattcagcctacatgtggctttaaaaaaaaaggtgaaataataaagtaattaaattttaaaaagaagagaagagttattaaaccttgcaacctagtcccgttgaacacaattatggctctgaagcagaccttcccattgaatgggtgaagaaacctagtgagagctcattaaaagctgatgtaaactcaatacccagcctctggtgttcagtgaggacagcactcatagatgatgggttctttctttctttttcttttcttttcttttttctctcctctctcccctctctcttctctctcatccagactgggtctctgttgcccaggctggagtacagtggcacaaccatagctcactgtaacctcaaatatcctgggctcaagtaattcttccacctcagcctcccaagtagctaggactacaagcacatgccaccatacccagctaatttttattttttttgttgagacagggtcttgctatgttatccaggctgggagaacattttaaacaaagggagacagaggtctaaaaatagataatgcataggagaatggtgaggtaaatgctatggccaaggcacagggcgtgtggaggaatgagttgggtttttgaagttgattagattaaatcatggagtctttttcttttttgagataagctcttgctctgtcacccagactggagtgtaatggcacaatcacagctcactgcagcctcgacctcccgggcttgagcaatcttccccgactcagcctcctgagtagctaggaccacagacacacaccaccacccctggctaatttttttaatttttgtagagatagggtctcactttgttgcccagactagtgccaaactcctgggctcaagcaatcctctcctgccttgggttcccaaagtgttggtataacaggtgtgagccacagcatgccccagtgagggatggttcttggtatccaactatcacaagagtcagtaccctctttgtttactttgtttttataaaatttatccatatctgattttgactggggtattaagcctttttatatattgactataaatggtttttaggttttaggtccttcattttgctctttgttttctatacatattttttttgattttaggtttgggggcacatatgtacatttgttacatggataaactgtgtcactggaatttggtgtactgattatttcatcacccagcaactgaccatagtacaagataggcagttttttgaccctcatcctcctcttaccctcaccacctcaagtaagccctcgtgtccatgtttatgcccatgtgtactcaatgtttagctcccacttttaagtgagaacacgtggtacttggctttctgttcctgctttaattcacttaggataatgacctccagctgcatccatgttgctgcaaaggacatgatttcggttttgttttttttaaatagctgtatagtatcccatgatgtatatgtaccacattttctttattaagtccaccactgatgggcatctaggttgattccatgtctttgctcttgtgaatagtgccacaataaacatacaagtgcatgtgtctttttggtaaaacgatttatattcctctgggtatatacccagtaatggattgctgggcagaatggtagttccgttttaagttctctgggaaatcaaactgccttccacagtggctgaactaatttacattctcaccggcagtgtataggcattcccttttctccacaaccttgccaacaactgttattctttgactttctaataatagctattctgactggtgtgagatggtatctcgctgtggttttggtttgcatttctctgacgattagtaatcctgagcattttttcatatgcttattgggctgcatatatgtcttcttttgagaagtgcgtaggcaaaaaaaccaaaatcataccaaccacactctcggattatagtgcaattaaaatagaaatcaatactaaaaaggtctctcaaaactatacaattacatggaaatgagacaacttgttcctgaatgacttttcagtaaaaaatgaaattaagggagaaatcagaaagttctttgaaactaatgaaaacaaagatacagcataccagaatcactaggatacagttaaagcagtattaagaggaaagtttatagcactaaacacttccatcaaaaagctagaaagatctcaaattaacaacctaacatcacacctagagaaactagaaaaacaagaacaaaccaaccccaaagccagcagaagaaataaccaaaatcagtgctgaactgaatgaaattgagatgtgaaaatccatacaaataaatgataaacgaaaccaaaagttggttctttcaaaaaataaaattgatagaccactagctagattaataaagaaaaaaagagagacgatctaaataaacaccatcagaaatgacaaaactgacattaccaccaatcccacagaaatacaaagaaccctcagagactattacaaacacctttatgcacacaaactagaaaacctaaaattccagataaattcctggaaacatacaacctcacaagactgaaccaggaagaaactgaaattctgaacagaccaatgacgagttccaaaattgaatcagtaataaaaaacctggccagggccatggctcatgcctacaatcccagcactttgggaggcaaaggcaggcggatcgcttgagcctaggagttcaagaccagcctgggcaacatgacgaaaccttatctctcaaaaaaaaaaaaaaaaaaaaaaaacagccaggtgtggtagcacatacccgtaggtccagctactcaggaggctaaggtgggaggatcacctgagtctgggaagtcgaggctgcagtgagccgtgatcatgccactgaactccagtatgggtgacacagtgagaccctgtctcaaaaaataatgaaaaataaaaaacttaccaatcagaaaaggccctggaccagatggactcacagccaaaccccaccagacacgaagaagagctagtaccaatcctactgaaattattccaaaaaatcgaagagggactcttccctaacccattccatgaggccagcagcattctgataccaaaacctggcaaagacacaatgaaaaaagaaaaccccgggccaatatccctaatgaacacagacacaaaaattctaaataaaatactaacaaactgaaccagcagcacattaaaaagctaatgcaggccagtgtggtggctcacacctgtaatctcagcactttgtggggccaaggcaggcagatcacttgaggtcaggatttcaaagccaacccggccaacacggggaaaccccatctctaccaaaaatacaaaaattagacaggtctagtggtgcaaacctgtaatcccaggtatctgggaggctgaggcacgagaatcgcttgaacccaggaggcagaggttgcagtgagctgagctcgttccactgcactccagcctgggctaaagagcaagactccgtctcaaaaaaataaataaataaaaattaaaagctaatctaccacaatcaagtagtctttactcctgggatgcaaggttagttcaacataggcaaatcaataaatgtgattcatcacataaacagaattaaaaacaaataccacatatcaggccagccgcaatagctcatgcctgtaaccccagcactttgggaggctgaggcaggcagattgcttaagcccagaaatttgagaccagccggggcaacatggcaaaatcccatctctacaaaaaagaaaaaaaaaattagccaggcatggtggaacgcacctatctactactactcaggaggatatagtgggaggacacattgagcccacaaattcaagaacagcctgggcaacaagacagaataaattctgtctctatttaaaaagaaaaaaagaggccgggtgcggtggctcacacctgtaatcccaccactttgggaggccaaggtgggcatatcacaaggtcgagatggagaccatcctggccaacatggtgaaaccccgtctctactaaaaatacaaaatttagctgggcatggtggcacgtgcctgtagtccccactacttgggaggccgaggcacgaggattgcttgaacccaggaggtggaggatgtagtgaaccgagatcgcaccactgcactccagcctggtgacagagcgagactcagtctcaaaaaaaaataaaagggaatatactgtatatttgaaaattgctaagacagattttaagtgttctcaccacgcaaaaataagtatgtgaggtaatgcatgttaaatagcttgatttaaccattcagtgtatacatatatcaaatcatgctgaacactataaaaaatatagtatacaacttttagttgtgaaaaaaacatgatttattaaatatttctcccttcttcatcaactccctcttccttttgctacctcacagtctttggaattctcaatctgaaatgtacccatccctcaaaactcaatttaaatcccactggccacaccaatgctatgaaattcccctctctgaatcctaaagcacatatcctcattccctttatgctgttactttttctatgtttgccttgtctttccccaaaagctgtaagatccttaagggcaggagccacatatcactccctatcacctccaggacactcagcagagaaccttggatatatttaggaagaatccggttatactcaattgtgttaggcctcaatttacaaatcagacatgacaaataatatatcacaccaaaaagatcaagaaacttctccaggcattaactaaggcttagaaaaacacctattcagcctttcaaattatccctttgaagtaaggacttaaaggtgagaagaaaagatataatcaattggggaagtttagactgtcttctcactcttttttttttttttttttttttttttttttttttgagacagggtctggctctattgcccaggctggagtgcaatggtgcgatctcagctcactgcaacctctgcttcctggggtcaggcaatcctcctacctcagcctcctgaatagctgggactacaggtgcatgccaccacacacacggcaaatttttttattttttggtagagacggggtttctccatgttgcccaggctagtctcgaactcctgagctcaagcgatctgcctgccttggactcccaaagtattgggattacaggcctgagccaccacgcctggccaacttctcactcttaaaggcaaaatagtgaacagcaacttaaagatcaaaaaagctaaggatggaatattcaacaaggcatcacattcaacaacacaccactggtcacacacatactggctgaattccagactccctctctatggtaaaagagttctgcaggctctgatgttggctggaaaaaaactagacacctgctcttcccagcactgaaatatggccaaaaaaaaaaaaaacataaacacacagcaaaatcagcaaacaaaactaagtagcatttaggcggggagcagtggctcacgcctgtaatcccagcactctgggagcccgagtcgggtggatcacttgaggtcaagagtttgagaccagcctggccaacatggtgaaactgcatctctactaaaaacacaaaaattagccagggtgcggtggtcgtgcacctatagtcccagctacccggaggccgaggcaggagactctcttgaacccagcaggtggaggttgcagtcagccgaaatcatgctcctgggtgatagacagaggctgtctcaaaaaaaaaaaaaagaaaaaagaaaaacagctaagtagcatttagatgaaactatgactctgaagtagggggtgcggcaagtagagaggaaagaatgtatcataatgccttaaacaaaacttttgagtgagagaagactataaaacaccctttaagcacttattcactggactccatttgtgtttctaagaaataagatatacagactcacttcagaaggttttctcctacactgtatctgagacaccataaatagaaacatacattatgttgccactctatcacaagactgaacctggacacttgtaaggaaaggaacaaccataaagacagttggccaaggacaggattgacattcaccctgggggagctcctcgtagtagctacaagccaacccaaaacagcttctgggtttgtgatgctggtgctggctagtatgctgcataaatgttgtttgtttttgtagagaggggtctcactctgttgcccaggctggtctcaaactcctggcctcaagcaatcctcctgcctcgtcctcccaaagcactgggattacagacctaagccaccgcgcctgacctacaaaagtgttttcttcccaaccacagcactgcctctcaaggggctaacactctggcagaaactcgtgaaaaccaatttcacgtcagaggaagcatccccaacattctgtcccggctctttttcttaggtgaagaaagggacagggcggggggcggaacaatgatattaaagacactggcagcatgacaaccaaaataaacgaagttgaaacagtacgtcctgccttcttcctaaagccatttccttcaacagcgataggagtgcagaccgtctgcaagtcattagtacgctgctgtcttcactgtcacaaggaccctggaaaccactgaagagcaaaatcccccttttcgccccacagataccttccaaccccctttctgtgcttccttccctagaaaaaaccgaagagtgacaatcctcagcaatccgctatttcgcttcactgacaagggaggtggcgggggcggtggggggtgaaaagtggaaaagaacacagaggaaggtgagaagacacagtggaagaagtgtggggggaggtcatcgtaggaaaaagaccaggtataaaagaatgcaagaaaattgaggggagagttatcagagggaaacttgctaagaaaaaaaaaaaattaaggacacgggaggtgaagaggtgaggtcaggtggagcagcccaggatgaattaagaggtgggcaggaggtacggggccgaggccgtgatgcccagggtttagggccggcggcttagaagtgggcagcaggtattcggcagaccgatgtccggggagtcaatgatgtgcagaaagctccagacccagttccgggaaatcggggccaggaatctatgaggttcccaagtatagagaacacagcgctcttaccggtagtttggggctgacctcgcccttgcaaaagtggcagaaaaaccggtgggcggcgccgtggagcagggggcggcgctcatcggggaggccccggccgcacaggagcccacggagggggcgggaggctcaggcatggcgggctgcaggtcccgagccccgccccgcgggaaggcagctaaggccccgcgagaaatcgagcacagcgccggtgggctggcactgctgggggacccagtacaccctcctcagccgctggcccgggtgctaagcccctcattgccctcactgctccgagtgcggggcccgccaagcccacgcccaccctgaactccggctggtctgcaagcgccgggcgcagcccgggttcccgctcgcgcctctccctccacacctccttgcaagctgagggagccggctccggccttggccagcccagaaaggggctcccacagtgcagcggtgggctgaagggctcctcaagtgccgccaaagtgggagcccaggcagaggaggcgccgagagcgagcgagggctgtgaggactgccagaacgctgtcacctctcaaaatgacgtagagtttacagataacctactcacatcctcccgtatgctatgtaaatagttgttatgtggtattgtttagggaataatgacaaagaaaaaagtccatatatgtacagtgcaaacacaataataagttttcaaaaaatattttggagtcaggcctggttgaatccatggatgcagaacctacagatatggaggatcaaatgtaataaatctctctctcttactatatatatgtgtgtgtgtatagtgtgtgtgtatttatatatactgtgtgtgtgtgtatatgtatgtatatgactattgatacagtggtaaggagtaggggagggaagtgttccataatcctatgattaggtctcagtcttgtggtgggcctgtgcccctgggctgtgaccttcaaaagtgcttctcaaattttgttccctcttaggtgagacaggatggctagaggtcactggagttgggtatttccctttccctacattggttagactctggaaacagaattttcttttgagggcatgtgtttgttaagtagaacagaatgcaccgggcatatttttcaacagttacctctccttcccctccagaagcactcaaggagttttctctgattctcaccctaagtcttctggagacaaaactcatgaaggtatgggaggctcccactagttaggcccccaggagtttttacctctcaggctaggctgctgtcagctccagcaattagccaactccctttgaagtatgtctacccaatgctggctccagtggtggtttctgatccaggtaagttgtgattctctgtatttgcccatggctccaggtttcatagggttggcatgtcttaggacctccattttctgttgcatataagtagttattgatgttcggtttgttcagcttttttctggtgagagtgggagtgatggcttttaagtgctttacaagtctggttgtcatttctgataatcatgtgacaattttgatctctttaaaaaggtaatatgtttaattcaggaattgcgaaaagccttgcagcagctacaagaattgcagaataagagccaacagcttcgtgcctgggaggctgaaaaatacaatgagattcgaacccaggaacaaaacgtccagcacctaaaccatagtctgagtcacaaggagcagttgcttcaggtgagtttacatgatttcaatgaacactgggctcatagaactctgaaatttgtttatataattttaagatattaatccacctgtgctgagtccctgctatatggaaaacattgagaggtgggaatcaggaggatttaaaataaatagaaaatataatttgtgaattaagatgcttactaacaagtgtaagaaacagtacatatagccctgatttatgcagtcttttatgaagtcttttataaagacttaatattcagaaaatagttattaagcacctctgtgagtcaaacacttttctgggtgttgggaagacaaaagatttggctactgatctcagtgtaatagatgaagacaaactgtacagaaacttccaaagagtaattttgatgatagaatgaaagtttgaggggaagatggagcattaagaagagactgatctgttctgccacctactctaagcttcagtcacattgaatccactacatttcactgaatgtacaattttttcattgtatgcatagtgtgcatatttttttttctctaacatgtcctcctctccattcttcacttaggaaatcctagtcctttaattaagactcactgcaaatattacctcctctgtgaggtctttactgacacctgcaggcggagttaggcagtgcatcctgtgttcccctggtggctagcgtatgttgcacaacagttaattctatgtgttgtgtctggtgtatgttgcagaatactttacaatttatgtctgttatctctgctaaacttgttacttttgaggagagtgatcacatcttgtttttttatcctgaataactaacaaattacttggcaatttagttaatattggataaaagaataaaagaaacgatgttttggtctcaggaatttcgggagctcctacagtatcgagataactcagacaaaacccttgaagcaaatgaaacgttgcttgagaaacttcgccagcgaatacatgataaagctgttgctctggaggtatgtatcatcatttcgcccactatgctatggattattctatctacataggtattatagaaatttgtgtttacttaaatttgctggttttggatttggttttctattctgccatcgtgttaaataacagcgatcaggatagattattgaacagatggtatgtgagcacttggaaagtggtgagcattagaaaccagaatttctctaagagcaaggtaggacagattaaataagtggaatgaagggttttgcaaagacagagatgtaccattctccaggctgcgggggatgttgagccagcatgctcttcccaccaacatagggccttccttccctgctccttagctctgtttgtcagggcggatgtgcttggggtcatcttcctgctgagctctggccccatgaaaataaatcaatcctcctgtgttcctctcaccagagcactcccaggagatggaaagcctgagggaggctctgctgtcctctcgatcccaccttcaagagctggaagaggagctggagcaccagaaggtggaaaggcagcagcttttggaagacttgagggagaagcagcaagaggtcttgcatttcagggaggaacgcctttccctccaggaaaacgactccaggtaagaggggacccattgacagagaaggtagcattcttcattcttacattcattcttacattataagaagggatattggcaagataattggtgtcctcttttggaaacctcaatgttccctctgccattcctgatttttgtgtgtcagtggggtggggggaggggcgctttgagcagaagaaaggacttctctgggaatgccttgtcactcccaagttgagagagtaaaactctgttatagaagtcttcagtatatcagagacatgaaaaagaagggtccccatgcttccaattagatataggacattagtctcaccatcacctaggaagcttctatactggctgtgatgcttggtcccagcataagccctgtaactgcttgtcaggatgcaaagagcactgtaggagcagtaaggagactgtgctggtgtgtctgttctgctctgaactaatgtaggtaatggtgtgttttcaagcaaagttacttgacctccctcagccaccatttccacatctgtgaaataaaagtgatgatcttcctgaccccctgagttgacatctggggctcagaggtaaccctaaccgtaaccctttatgaccctctgagttgacatctggctctcagcctgttgctctggtgtggctgagtggctctgccatctcagtgggccttgcctctccctggtcagactgaagcacaagctggttctcctgcagcaacagtgtgaagagaaacagcagctctttgagtccctccagtcagagttacaaatctatgaggcactttatggcaattccaagaaggggctgaaaggtatgtgttcttctcccctcaccccatgagctttttgcccttgcataggatgctagtgaggtctttcctttgggagttgtggagatcatgggaagctacagagttctgtctcagaaactcccacccgagcctggggctcccaataagaactctcatacacaaagcccaaggtgacaggttggtgacacgaacaagatccagcctgatcattcctaattattttaagaaaatctagacattcctatcaatgtctaaattataacatttttgaaagcaaaagaactgtcctaatgatatcatcatttgaaaaggcctttaatattgtcggtgatacatactgacaacccattcagcccaatgcagcaggcagtccgctcccaccctgaccctttccctagtgacatctggcgctcagcttattgccctctcatgtaattttcataaatcctgatttagtttcctgattttctaaagagaaggtgaactggaatttgaagaaatacaggggcttaccaggctgagcgaatagcttaagtacaaagtcatggtgagtgttgagtcagtggggaccagcctgcccacaggagaaaattaaaagacacgaaaacaaaaaacccttatagaaataccactgataggacctaaatttcaatcctggatttaaatattaaggacatttattgaagactttgttgcctgctgaaataataatctaatatttgagaatttgatatatttcttcattctttaaatggagaagggtattcaaaacataatgtgaataagtcacagcaggctgggacagaggactgacatcaatgtcatgaaatttagcaaagataaaaagcaaaatcctgagctcgattaaaaatatcagtggtagaaatataggatgagggtagaaatataggacaggcggccattcgtggacttgagagtatggggtttggtagaaacatgatcacacaagtaagtcataggccagaggttgctagaaatgccagctcaaactgacactacagtagtgtaagtgtgatgttcacctgtggagaccatggtctaaaatattgttagattaaggggcactatctttgaaaagggcattgacacactagggaacataatgaagacagggcgcacaatggtgtggaccagaaatctccaactggtcaaagaaactaaagaaatgtaggctttcaaaagatcttgaggacatgagaactggcttcggatatttgaagaagtgtcaggtgaaaaagaactcatgtattttatgtccctccagggggctaaacaatgcgtgaagggcagtggaatttagattggaattatcataaatcctgatttagtttcctgattttctaaagagaaggtgaactggaacttgaagaaatagagggggctcaccaggctgggagaatagcttaagtacacagtcatggtgagtgttgggtcagtgggaccagcctgaccacaggagaagcttggggttgggggagtgagaagtcaggatggtggagtagagccaccaaaccgtgaaagctcacaggtcagggtgaaagttgacattctgtagagtagataatgaaactaagtctattctttttcaaagaagataagcatatgatgaaaacagaactttaggatgctaagtctcaggggatgtcctggaattgggagacattagaatctgggaaacctattgggtgggtctagtgatattgtgacacattaagagatgacagtctaatataaggtgctgttgggaagatgaaagggtatagatagattttaaaatgtctcttaaaaaaataagcaaaatttagtgagaacttggattgagaaagagagagaggaacatcataaaacttcgggcaaaattcaagagtagattacttaccaaagtctctgaaacgacttcatcctgagctccctttcctttcatgcttttctccctgccttttaggactcatttcaaagctacaaccactaaagctccataatcccttatctgtaatttcaaaattcaatacgatctccaaactaaatttttcaaatactcatttagtgacaaaatctagatgatctgacatgaggatattcataagtctttatttatctacttaggatattcacatagctcattgcagaaatagttatatgtttgattaaggattgtggttcacctgcaactgggtacatgttatatatgatatatgcaccctgttgccttgctaaaaactaaaacaaattttacctttcgaaatacatttggccttaaggttttcagataagggattgtagccttgtagaatatttcttagatctcttcatccccagtacaaagaaatagactacatgtggtgaatggaggtaaatatatgtacatatatatatttgtatatatatgtatctgtatatatgtgtgtatatatatgtacatgtatatatgtacatgtatacacctatatatagtatgtatatacacacacaacatatatatacacactatatgtaggtgtatatatatgtacacacacatacacacacacacacacacacacacacacacacatatatatatatatatatatatatatatatatatatatatatatatgagagagagagagagagaaattgaaaaactcagttataatccctggtctaatgtgcccaactcgcattctcacatgctaccaaaaggcctcctccttctcctctttcatttttgagagtgaagactgtgaaatctctttctccctcatcccctacccttctctagctcagtactgacgttctaccttggaggaccctatactttagcctacaggactaaggttactatggagatgaaatatggacttatccttatctgccaatcaaatgctctataggtgcatgtgtgtaacttaaaccgcaaggaagtttcagactggatgtgtgccatctcagtgccatcccccggccacacacagaaatggtgacatctccatcacagatgggttgcatgagactcagatgatagtggggtccttggcagaaaagaatgtcacagaggagggttctgacaagtgcttggaaatacttgggtcaatgttaccagactcctcttctctcttagcttacagcctggatgtctgtcaccaaatccctttgagcagtgacttgagccacctggtggcagaggtatgaggtctgagagggcagctggagaagagcattcaggggaacaattgtctgtgactgcagctgcaacagcagctggatagcctgctggcaaagccagcctcagcccctcctctgttaaccagaacttcccagccagcgctgaccctggaaacaagcagctgctcctccaaggtaggaaggaaaagggacttagaaagcccttggccagtggggagatcaccaggatgtctgcctggtccatgctccttatggtcaggttgaaatcagagatgctctagtctagcagcctgagtgaaagcgtgggatttaggtcagactgggctccagattctgagtttaccgcttagaggtcgtttgatttgggcaaggtgtttaaagtctcagaggtttaagccttagtttccttacatttaagatgaggataataataatatataccttatatgattttgaccattaaatgagatcatttacaagtgcttggcacactaagaattgctcaataattagcagctgtatatgttcatatctttttcttggatttgcttggtgctttagttttagccaagtgttttcacatatataatttcacctgaagtaaagcaggttttgctatctctgtatttcacatgagaaaatttaggtcctgagatattaacagacaagcgaggctttagagaagttatagacaaagccaggatcagaaccagatgttgtgattttcagtctgtgttccttccagctcattgtgccctgtctcagtattgccgaccttcccagattctctagtccccctttccctcacaggtggggaactcaactgtgtggcaaaatgttcctgcccctaaggaaacagggctctggggaagtcctggatggtgggtgatttatttcgggcggtcatcattcgctttctctaccccaccccttgcctgccttttcagataggcgtgtttgaccaggtcccccttctcttctcaatatcccccatcaatctcacttctcccagttttcattgaaatgtcaatggtgtccccctagtctcttaaatcattcaatttctacttcctctgtccttttctccttttgatacaccgtttagtacaccatctccactcacctccatggccataccttcaattttattcaaatcaggaaccacttctgttcagtttctctaaagctgagctttcaaactctcctgccagctatttctgggtcatgttaatcattatttttctctggttcttgtagatgctcatttatctgacagtaaccttatttgtcaaatgaaggtgacaataacatgattatgctgttttcagcttacattaggtggatgccttgcccttctctgggctgccctgatggttgtggtgttcagtgatgtctccaactcttccttctttctaaccaggccttcctctctctctggcttcccacacagcagccaagactcagccccactggtgcagtccctgcccatctttctctagcacccctgaggcctgagctggaaagcaggcactgggccacacttgcctgagtaggaccttttctaccttctttgtgatattttccaattcctccaccatagggttgctttttagtctccagcaagatgttaacccaccaagccctctctctccgttcttctcatacaagtcaatttctttcagtattacctcatcagaatgatgactagaatgttgagtttagtcccccatgaatccattcattccttgatcccttgattctagattttaatatgtactatgtatatttatacatattacatttagttacggggcatcgtattagataccacacacaaattatactcaagacttggtttataaaaatacacctaataatttttcaaactagaagttacattctcctggaacacccctcctttaaaggaatatctttttgttctgaagaatggaaacattctgaactcagtgactcatgggcttttgcttttgcttgtggggtatggataattctgtaagaggagagtcctgccaccttaggtctcagtggggacggctaggtgtgcatgtgcttcatgtgcagtgtgttccagggctcctgaaaactgtggttgcctttaccccctagattcagctgtgtcccctccagtccgggatgttggtatgaattccccagctctggtcctccccagctctgcttcctctactcctggctcagaaacggccataatcaacagaacacatggtaaatatggcaactaaagggcccagggactgatgttggaaagtgattaatgcaaacaaccttttgttgtctctaaacatattatctgtatttagagagttttctctgcatgccccaaggcctttagccctactccctgcaccttctgtggctgcctttcttgccattgttcatcctcctgtagttttcctactgctgtttttgcttcattgcaccataatctctctattcttgaaaatgctctctgtatccagcttgacttccctgtctgtgtcttctctacccagaaacttattatttatgattcatcctatttcatttgccaataaggaaaaaattgtctcctggcaaatttatcattaaaagataatgtaagaaaggttataaaaatatagaagccagaagatctctatggactttgccccacccttgtacattccaaggcttcctttcttgttcccagcctcgtccttttcttgttccctgcctcttttttagttggagcaaactgaggatatcattatgaataacagaagattctgttgtgttgtcattttctttttcaggcttgggtttggatacttctccagtaatgaaggcccctcccaagctggagggtgatgctactgatggctcctttgccaataagcatggccgccatgtcattggccacattgatgactacagtgccctaagacagcagattgtggagggcaagctgctggtcaaaaagatagtgtctcttgtgagatcagcgtgcagcttccctggccttgaagcccaaggcacaggggtaatcacacctgaagctttaggtgcactcttttcttgtgccctttcttcctttgatgttaactccttctcccaccatttttgttttttcatgctttgcatctctcaacagctgaggcttcctcttccatgcatagcagccaggccctttcttctctatctcctattttcactgtgagttctgctctgttccagatgtagctgactggatatttcccctcagccccacagaaacaggtggcattgcctagcagcctttggtagcttattatctaccacagtcatgcaggcacatgaccatatgtgggcagagtcaactcaatgggatggacagaaactgaaggatttgcaggtgtatggcccccacatgtggaaggggtgagaagcctggcagccaaggcatttccttgtgcagactgcataggggagggaaggcagtcagcgaagcttctgagagcaccttgccagtgagagagaccaggaacctgtggctatgctgtctgagctgctggagacccatggatgcatagggacagccctgcctccatggagcccccacactggaatgcaagacacacacccaagtagataagcacagtacggggctacaggcgcagtatgagaaatcatcctctgtgctgtgagagcaccaatgcaaatgtggtcatttatctcaggcaaggaaggtaacagattcatagaggacatagcaaggggggtgagttttgaaagccttgtgggttctgcaggtggaggaaggcattcctggtaaaaggagcagcaccttagttctgagagctgcaaatggttgtgcgagggcttcacaggttcaagcaggcccatgttctgcacctcactcacaaaggaagcttgagcccacgcagggggaaaaaagtaatctctccgctcctgtggtgttacctttccccaggtgctaggcagcaaaggcattcatgagctttggagcagcaccagtgccctgcaccatgccctagaggagtcggcttccctcctcaccatgttctggagagtggccctgccaagcacccacatccctgtgctgcctggcaaagtggtaagacgccagtgtcctttcttggttcaaacccagttctcctgccctccaatactgttctgtctcctcagtgtcacagcttttccagaaaatcaggagccacacagtgaattgggatagacaggaacttagaggagtgtccctggagggacatctctgacccttggtggctgctttcattgcagctctaaatacatcccattccccaccagccccctgacccctggataagaaatcaaagaagaggaggaaggagtgtggagaaggcggagacatcataaccctggcaatccataaatgttcagtttctttacctctctgaagtttggatgagctgaaattcagttaaagctttagcacatctcccaccccacaggtcccgtggtcaaatgatcacagaatgcccccatgagactgagcctttttagccactgcctggaatcccaacatacaacttaagctggcattgctggaccaggcctggggaaagtcagcctcccctcaggatctgctcagagctcaggctaactctgattggcagaccctcatgtaggcaggtttcaggatcccctccccagggattctacttccaggtcaatggcaccaataccttttggatccaactatgctaattccagggagagggtgttgtgccatcttcatgttggcacaaatatttacaaacttgcaaactttcctgagtccagatctctctccccagcataacacttctgaactctcaatcttacctgtgaagggagagtgacagaactgatatcaggactaaagcaaggtcctcttcagagttgggagtttgataccagcctgaggcgaggttctcttaagctacaggtgtgtaggcctgtgctagtctgcatggggaattccagagtctcattattcctgcctaatggcctcatcctaaactgtcctcagctggaggtattcaaggctgtgaaggaggaaatccagttcaggagggttgagaagattgtagaatcctttgaactggaaagagccacaaagcacagggtgctttatgtcttctgcctggtcagtaagagtctgttcctcttatccagagagaatcgacagaaagggaacttctagaactgagaaccaaagtatccaaacaggagtggctccttcagagcacagctgagcatctgaagatcgccaaccagcagaaagagagcatggagcagttcatcgtcagccagcgtaggttccctgagagggaatgggggaagaaacgggcagtcttcccgatgccccacttgtgctgctgatgagcagtgactggggggcttggggatgttgggagttgaggctgatttgatgtccccaaacctcctgtgccccgagcagttgtggatgcagagggaggggaggacagggggtggatagcaggaaactccaagctgaatggccagagagaaataaatgctttagcattctcatgctaagcaagtagggttaatttctgctgatgatttctactctgtggtgctcttttgttgtttcagtaaccagaacacatgatgttttaaagaaggcaaggactaacctagagttaaggaaactactgcaccagtcagaggcaccaagcctgtccccaacccatcaccatctgttagcagatcttgtaggtgacgcttggcctgctttcgccttccaggagaagatttccagtccacttgtaagatcacaggtcctcagtgggcttcctgctagtttctgttcccatcaccctcccaccccatcagctcctgcccctgtatcttggttcactctcacattgtcctcatctctcctttttactccaatttttcttcgttgatgccaggtcaggagactggagaaatgcaattcagctcactctggaagtcattagacatttgggagtctgcctctgaatgagcttttggtagagggatcttgaggccagttatgtgttctactcttcatgaaaaagtaaaagcaatttgcaacctaataaactgatttcactgcacactcctgggttaagaacagcaatttgattttgatatttctttaagtaacacgacaaaagagatctgttgggtctcatttgtctaaaagagaatttgttaataaataacaactgaaccttcaggggaaaaatgttatatatatatcagacattatctacatttacttaaaacactaagtgtttaatcattccctaggaattgctttgaagaaaaacttgaggtatatgaaatggtttaaaaatcagaaactaaaccttttaacgtggacttcaaagctttgccataagcaattgagcatattcctagaaatgtttctaaaccataacctgagagaatgttgatctccatagtgtgaaaatgacttgggccagtttaacttgcacttttttttttctaaactaattccgttttgtttttctctgataattcttctctttcctgagcctctttagagcagcacttacaggattgcctctgtaaagccttattcctgtcccagaaaaggtaatccaaaaagtctctagtatccactgaaaggtaacccaaatgtttctagtatccactggttttctccagtgtggaagctttcccctccacctcccacagatcactggaaaggaccagaggcctcggtcctaatccctggcttatcactaactggtgtgtggctttggcttgtcccttagtctctgtgagactgctgcaccctcacctgtcaaagatggaactggacttagttgagctctgaggtccctgtggacttggcccctccacatcctcattatggcgactggacataaacttaacagaggacttccctgcagagtgtcctcttcttcctacaacaggctgcttctatatgtgcatgtttcatgctaagcacttctttcttgggtggagatgacaaaggcccctttctgctgagacaaagtgatttggagagtcacttggcccctgaagagggagtggtaggatccagccacccagtgtgcagtgaattggagcagggatctcaggacacagggaggtggggaggctccccctaacctcgggcacctgttgcttctccagactgcagtgcatgctcttagctcatcctcttaactggctctcactgtgctcctggctttggtcaccccatagttctcactccagcttcgggtagccatcagtagggcctggcaatatacactgatttggtttgttttatgtttgtctgcaggtgaaatccctaagggctctgccatgtactccagccttgtgacccttgccttccaggaaccatgcaagaagcgcagccaccggaagtccttaaaacagcaggaaaggttggcctgtcccccttttgtgcagctacctatctgctgaggagcatctgggcctcattcctccaagtccactggagggtccagaagagggagtcagagttgtatcctggtggagctggcagaaaggcagaaagcctttctgacagctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattctgatgaatggggcacgtggtcctattgctggagctcctctggcaggttctaaaagcacactacggagcagcggtgccctgccagacactgctcgtgggggctcagtgagcactactcacagatccacacctgaccctgttgggtcaagtcaggctgggttttggtctgcactgtagcacctgcgttctttgagttcacatcatgaatgtggtgacttcccagataccatctcaggcttaacctagcacatcctatttcttttcttctatgatatccaaattggactgacctcacttcaaatatcttgtcccattttgtcgtcctatcttacctcggggaaattggggactgatggccagaccaattctgttgaaattcttgcatagagcaaacctgtgctcatttttaagtggcatgggagaggcccccagccatagtaaagcctagtctgtgtcttcacagttttgatagaatgtgcttgtgtgtatagatgtatgatacagatttatttatgttgctatcgccatatattgaaggccaacataactggtggacagggtgggtgacagaaaatgaaagcctttttggtgattgttaaagcaaaatgtgtataaagaaataaatagttgttctttcactgctttgtttcccatttctgccccaattccttgacagtataaagaactggaaagagaaaatgggaaagacaaactgtgtttaagaagtgcacagtctaatgcttgaactctaactttaaaagattaaggttttccttctttgtcattttgtaagaatccccagtctgaaaatatgaaagaatggttcttaaacttggtgtaccttagaagcagctgtggagattataggaactacctcctggtctccaatcccaggagatttagttggtgtgagccctagaatctgcatttttttaatataagcaccccaggtgattccattacatgtgggctgcagatcacagtttaaaaaaacagtgttctataacattgaatcaaaactaaaactacatttaagaaccttgaatcaaaaagtatgtcattccataaacattgatataaaaattttaaaatattccttgggaaaagttcttagctacatgcttttgatccccaagattaaaataaacgtatcacttcacaattatttactagaaacatttaaaaaataaacaggtaaaaggtggagtaagatggtagaatagaattctccagcaatggtctccctgaaggaacatcaaattgaacaactatctatgcaagaaaacactctcacgagggctaaccaggtgagagatcatagcacctggttttaacatgataacaagaaaagatgcattgaagaagggaggaaggacagtcttgcattgcctatgacacctctcccccaaccacaggaaattctctgagagagaatctaatggcttggggacaaagaggaaaatgtgggactttatattgaaacttagtcttgccatagtgacacatgacactggacagaaccccacagcacttgattccaggctggtgcccacaaaagaagcatttagacccaccctgggccacaggggaatcagctaccccaggaggaagaacccaccaaaattctggccagctttatcactggaaatttattgggctacaaataaatttcagtggcaggcaggctgtagtggccgcagtccttgggcaagccctgatgctgcataggtctggaacaccctggacttgtggtgtgagccagtatgacggcagcagctgcagcagctatggaaatgcctgtatcacacctccccacactccaggcagtgcagcctgaagagagattccttttgcttgggggaaagaaaggaaagtaagctaggggctttacctgggaatgcagagaataatccctgatctttcccaagtccacagggctggagacctaacaatctgtaagaattgcagtgtacctgggcctagggtgccctgtagtacaaaaatggctgcagtgatcactggcttagggaactcgtcagcccactttgaattcctggaaggtcctctgaaggacaggtagaaacaagacctgactgcaaaggctggaataaataccttatccttcaatgcccagatattgacaaacatcaacagtatcaataacattgaagccaatatgacctcaacaaatggaccaagtaaggcactcagtgaccaaccctggagagatggagatgtgtaacctctcagggaattcagaatagctattttgagaaagctcaatgaacttcaagaaaacacagagaaacaattcagaaatatatcagaaatttaacaagattactgaagtaagagaaaaaaatcaaatgctggagctggaaaatgcattagtgggtctcagtagaattgatcaagcagaagaaagaattagtgagcatgcaaacaagctatttgaaaatacagtcagaggagaaaaaagaaaagaagaatgagcaggaacacagaatgcttaagagatctagaagagggcctgaaaagagaaaatcaaagattcattggccttaaagagggagttgagaaggagcaaagagtagaacgcttattcaaagaaataatcttttttttaaaaaaatactttaagttctagggtatatgtgcacaacgtgcaggtttgttatataggtgtacgtgtgccatgttggtttgctgcacccatcaactcatcatttacattaggtatgtctcctaacgctatccttcccccagcctcctaccccacaacaggccccagtgtgtgatgttcccctccctgtgtccatgtgttctcattggtcaactcccacttaagagtgagaacatgcggagtttggttttctgtccttgtgatattttgctgagaatcacgatttctagcttcatgcatgtccctgcaaaagacatgaactcatccttttttatggctgcatagtattctttggtgtatatgtgccacattttctttatctagtctattattgacggacatttgggttagttccaagtctttgctattgtgaatagtgcctcaataaacataggtgtgcacatgtctttatagtagcatgatttataatcctttgggtattcacccagtaatgagattgctgggtcaaatggtatttctagttctagatccttgaggaattgccacactgtcttccacaatggttgaactaatttatactcccaccaagagtgtaaaagcgttcctatttctccacatcctctacagcatctgttgtttcctgactttttaatgatcatcattctaactggcatgagtggtatctcattgtggttttgatttgcatttctctgatgaccagtgatgatgagcattttttcatatgtctgttggctgcataaatgtcttcttttgagaagtgtctgttcatatcctttgccctctttttgatggggtttttttttttcttgtaaatttgttgaagttctttgtagattctggatattagccctttgtcagatggatagattgcaaaaattttctcccattctgtcggttgcctgttctctctgatgatagtttcttttgctgtgcagaagctctttagtttaattagatcccatttgtcaattttggcttttgttgccattgcttttggtgttttgatcatgaagtctttgcccatgcctatgtcctgaatggtattacctaggttttcttctagggttttcatggtgttatgacttacatttaagtctttaatccatcttgagttaatttttgtgtaaggtgtaaggaatggatccagtttcagctttctacgtatggctagccagtttttccagcactatttattaaatagggaatcctttccctattgcttgtttttgtcattttgtcaaagatcagatggttgtagacgtgtggtgttatttctgaggcctctgttctgttccattggtctatatctctgttttggtaccagtaccatgctgttttgtttactgtagccttgtagtatagtttgaagtcaggtagcatgatgcctccagctttgttctttttgcttaggattatgttggctatgagggcccttttttggttccatatgaagtttaaagtagttttttttccagttctgtgaagaaagtcagtggtagcttgatggggatggcattgaatctataaattaccttgggcagtatggccattttcatgatattgattcttcctatccatgagcatggaatgttcttccatttgtttgcgtcctcttttactgattgtttgctgaaagtttgctgaattcgcttattaactctagtagtgtgtgtatgtgagtgtgtgtgtgtgtgtgtgtgtgtctggcctctgtgtgcatgtatgtgtgtttgcatctgtaggtattatttgggattttctatgcataggatcacaccatctgcaaattgagatcattttgttttctgttcaaaaatactttttctcatgtttatttttaaaagataatttggccaggtgtagaattgtaggtgacagtttttcttttttttaagtactttattgcaaacttcttgtttgtatgagaaatcttatgccatcattatatttagtgctctgtatgtaacatgttctttccctttttattcttcttaggatttcctttttatcactggttttgatggatttgattaaggcgttccttggtgaagttttcttcatgtttcttgttcttagaataatcatatttctgtaatatttgaagtttatggtttccatggagcttctaaatctttcatccagtatgttttaaatatctttgtctctcttctccactacacgcccttcagggattccatttagccctatactagggggtttaaagttttgatgccgatggtctttttatgttttcatgtcatttgttactgtgtgtttgatttatgttagtttcaacttgtattccttctagttcaataatcttctcttctgcaatgtttaatccactgccttcttccatttcagactgtaaatcatactttttatttacagaatttgatatttaaaaaatcttcaacctccctatttaattaaaatacaattatactaactgctctaatgttcttttcttctatttccaacatgtctgtcaatttcaactagattattagattcttcattatgtgtcatgttttcctgcttctttggctgcttgatattcttttatttttatttatttttttttgcggggggatagcgttttgctctcgttgcccaggctggagtgcaatggtgtgatctcagctcactgcaacctccacctcccaggtacacaagcgattctcctgtctcagcctcccaagtagctcagattacaggcatgcaccatcatgcctggctaatttttttgtatttagtagagatggggtttcaccatgttagtcaggctggtcgtgaactcctgacctcaggtgatccatctggctgcttgatattctaagatttgatgctggaactttggtgtcaatgctcaaaatgcccaaagacaccactcaacctcagtgtctatgcacacccaagcttttgcagcaggacaggtagagcacagatgagtgtgctacaacatgctggtagaaggtacccccaattgtgcttggggatttcctattcctcatgcaaaaatgtgtcttccttaatttttcccataagaaccaccctacttcatgccctgtctctctgtccaaacaccaggacagtcctctcaccagtctcaaccacccaatggattgacaaaggtgcaaatatgattcagtggagaaggcattctcttgtcaacaaattgtgtagaaacaactttttttacacaatttgtttttctttatccccataggaaaaaaattcacctgaacctcaatactaactcaaaaattaactcaaaatggattatgcaactaaatataaactataaaactagaaaaagtatagcagaaaatataagacaaaatcttcatgacacagagttaggcaaagtgttctttattatcaataaacacaaaccattgaagaaaacattgataaattcgactttataaaaattaaaagtttttgctcaacagtattaagagaacaaatataagctgcagtttgggagaaaaacagtggaaatcaccaatatgacaaagggcatgtgtgatagttacttgtagttgtcactgtgaccgagcaccagggtgccaggacatttggccaaacatgattctggttgtgttccagagagtctttcagatacgattaacattgggatgggcagactaagtgaagcagattgccctccttaataggggtgggcctcatgcaatcaatcaagggccaggagagaattaagaggcctaatgggaaacaaatgctttcctggatatccagctttccttccatcttgggaatttcagcctccataatctcagaagcaaattcatgtatatatatacacacacatatacatttcataggtatgtggctaagattgtatttttacaagttcagccatgagatgattggtgaagccagccaatgaataagggtgtgttctattatacgattcagtcttcttttgtaaacgattgaagttctgcatttgaagtaggaggataggagggagcaagtccacctaggatgataacagctgaatttctcaacttacacttcagagccataggggtcaacttagagactcaaaaatctcacccataatcctgccctaaacaccagggctagggaacactgtggccctcaggtgattttctttagccaggactgggagccacacgacggcagagggagcaggaaacactatgcaaatagaggccaggacagcagggagggcctgttcatgatagaacccaggcaaaactctcctcagaaagcgagtgtggagaaacatagatcatgcctgagacctggtggattagagcactggctactggggaattgaaaggaaggggcttcaccgtgcagaggaccagaggtgccaatcttggaaatgcagaattgctgggagatggggaggcacggaccatggaagtatcctctggagactcatggcgaagagaacaaatgaatgaagtaactggcagaaattagaggtcctggtagaacaaaatagaatcccacaatgagaacatacaccatgtatgtcccccaaggatgacaatatctcctaaaagctccagaaaaatcattttggacaagcaccttatatctagtaatgtgatccatgtatcgagaccgtgagaaaagattattaaacatgctaaactcagcgagacctgattccctcatgaggactctgttaaggatgagtaccactcagcaagtgatgacagtgacattcacttttgaatagctcatgagcgttaatatatttcattatggatctaaaccacaatggataaaaaccaaggtaggggcaggatgataatcacagaatgtcaccggtatatgtttaggttcaaatactattatgagaagtggcaggtaaaggaggtaggaaaaagaaaacacatcatgtaattgactgttgtatggaaatatttgatgctgaaagttataatttaaaactataaaccaaatattagaagtgtgtctagttcaaagggaggaaaaccatcaaaaacatttttagtgcaatatttaacatgagctatacaacccttcctaaatgccaaaggcacacacagacacacacacagacacacacacacacacacactcacgaagaatacaaatgactagaaccaagaaatgtaaatacattctgctacgtatggtaaacatagcctacaatgtggaagagattagaaaataaacatggaaatgaaatgtttttattaattcgcatcagtacccaccaaaaccaatcagcataatcaaatattataacactgaatgtaaaaaacaatccaaaagtccagagtgataggcaaaaggttttaattgtatagattaaaattaactttggacaaaaattaaaactcaggcaaagaatgttttcttctttttgcaacagcagacactagtaaaaacaaaggcacagtaaaaattgagacccaaaatttgcagcgtagagatatgaatataataatagacacaggcagggaggattaataaatgataaaatgtttagaggatgatcattagaatacaggatatttatactcttgaaaaccactttcccaagtacttcattataagtaaggtgtctctaaaagggacagatctcctagacccctccttaaccaagtaaccagtcctgatatcataatggtgttggacaaactagaccttctctgcccgcagatgggctgaggttggaaactcacagcattgtctctgcagtgttcccgtcaaaaagtttaggctgaatttaatcatgaagacattttcagacaacttcagaatgtagatcattgagccagacagctgacctgtcctctataaacaagtccatgtcaccaccatccatgacaacaacaaaaagatgaggaaatatttggggttcaaaataactaaagaaatgcagctacattatctttttactttttttcaacccaaaatatctcttctcctttttgttgtgtgatttgtggtgatatggactatgtgaaggagacaggtcagttgtcctgctcagtgttctacattctgcagttgtctggtgattacctcctatgaaactcaggctaagcgttttctgcaagaacatggcattgctcatattctgcaccggcagagtcctgggtgacatgctgtctcctgccagcggctcctgactcctgttctctacaggatggaattgagaggagcagggctaaggcctcccaatgctgtttgtccatctagctgtggtcttcctaagtactgacaccaattggaggctgaaggactgtggcttctctaaccaaaggagcctagcgggttaacaattgtcaagagcagttggtggttctgaaatacaatcctcagccaaggatccctcctgtgttacagatggatcagctaaaacaagccaacactgaagacacaaagaatgaggttaggttcattgaaaccagggtaacacctttggatgagctaaacacaaagatgacactgaccttgagcaggtatagaagctcagagacatgcctgcaaaatgaaatccctgaggaattttgtagctacccagagatacgtggttcaaattaaaatgtccgactgatcactcccggcatgtgctgcacagttatgtgaacgtgtcacacctaacgtgggtccattgtcttcagactgagcacaggttgccactggcatgctctgagaataggaatagagccatgcccactgacccatcctatgtctgggcttccaaatggaactatagtttcattcaaatcttcaggtgcctataggtcctgcctgcaggaatgacacctctcggcttagtaagggctgcttattgtgggaatatgactcccatctggaagaccaggtggagacttctcaccgtcaaagtaaaaaacctattgtccatgtcaagggcaaagctgatgtgctgttcctcaaatgagtaaaacacacttctgtagtgctggaatgagtcaggtagttcaaagtacattgatggagtcgaataatatctatccagtgagtcctgtaagacttcaggcacttccacttccatcagcacgctgctgagcctggaaaaggagacaaaactaaagaagcagccagggaaaatcagacaccacagagccccactagatttcagaagtaacataaggaagtggttggaaaagaaaaaggacagatccattaatgaggtaacaaattattgcctttatgttgggatagaacagggccaggtagaaaacaatgaaagagaaagacagagagagagagacagagacagagacagagacagagacagagacagagacagagagaaagtgagctagtgaattggccaggtgacatactggtaagggagtcaaaggacactctgacttagtgccctcatgacacacagcaaactgtgatcatgaaaagagtgagctcaatagttttccataaaatatgctcaaaattcgatgcagtggccatgagagtacagcttttgaagtatggtccacctatggtacgttagtaaatgataaggggaggaagaaatggaaacctaaacatctactgcaatgaaaaccaacaacaatgacagtaggagtaattcagccttcgttgaaaacatgacatcaaacacactctggtttccctgaatctgttgcctccaggtgttaacacagaattaagcatccacaattgctgaaagttacctggggcatggtgggttttgatcttcttccccttcttttcttccccttcttcttttcttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacactgtgagagatatatttcaggaggcctgaaggctggtcgtgatagaaattcctcggtttttctcccagaaactctgggtaaaatgtccctattctagtagatcattatcccaatatcatttgtcccaagtttgtgcaaacagttatgccttatttttccaatcaatttaaagcaaataccctcaaatgatttctaggagaaaaactgcaatatttagccctgtctcatcaaatactcagattgttcatggttgtgaggactccagacactgaaattagagtgaaaaaggaaatctacaaaccctcgagtcaaaatcatagttctctgaatttgtcacatctgcccaggtccaatgtcatgagagtagaatcagagtgccacaggcatggcctgagactaggaagagagccatgctcactgacccatcccatgtctgggcttccaggtagaactagagtttcattcaacctacatgtgcctataggtcctcactgcggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccgtagggctggcaggagtcaggctgttcaagacaactggaaggagttgaataacatccagtgagtcctgcaagacttcaggctctactacctccagcagctccctgctgagcctggaaaaggaggaaaaagtaaagaataagccaggggaaatcacacacaacagagccccaactaggtttcatgggtagcataaggaagtggttaaaaaagtaaaaggatagatctattaatgaggtaacaaattattgccttcatgttgggacagaacagggccaaatggaaaagaatgaaagagaaagacagacacacacacacacacacacacacacaaacacacacacaaagacacacacacacactgagagagagagagagagaaaacgagctcagtgaattgtccaggtgacacactgatgagggagtaacaggacactctgagttagtgccctcaggacacacagcatacagtgatcatgaaaagactgtgctcaataattttccataaaatgtgctcaagtttccatgcagtcaccatgagaatacagtttttgaagtctggtccacctgcagtaggttagtaaatgataaggggaggaagaaatggaaacctaaatatctactgcaatgaaaaccaacagcaatgttagtaggaataattcaggcttggttgaaaagatgtaatcgataatgtcagcccgctctgttttccctgaaccaggagtctccagatgtcaacacagaagtagctgttcacaattgctcagttacctggggcacggtgggccttggtcttcttcctcttcttggtcctttttaattcctgcaatacattcagacagggacagacaaaataagccaattcacctacacccataacagtccactgtctaatccccacacagggatctcaggctcctcagcatgagaacaggacaatgtgagggatatacttcaggaggcctgaaagctggtcatgatattctttggtttgcatctcagaaccaagggtgaaatatccctattctggtagatcgttatcccaaaatcatttatcccaagtttgtgcaaacagttatgccttattgttcccatcagttcaaagaaaatgccccagaggatttctaggaggaaaactaaagtattcagccctgtctcatcaaatgcccagctcgttcacggatgcaagaattttagacactgaaattacaatgaaggaggaaatctacaaacccttgagtccaaatcatagttctgtgaattttttacatctgcctgggtccaatgtgctgagagtgggctcaggttgccataggcatggctggagactaggaatagagccttgctcactgacccatttcatgtctaggcttccagctgagactacagtttcattacaacctatatgcacccataggtcctgcctgtggcaatgaagtctctcgggtcagtaagggccacttggaacaggaatatcacccctatctggaaggccaggtggaggcttatcaccttcatagtaaggtactcactgtccacgtcaagagccaagccaaggtactgttcctccaatgagtaaacagcacttctgtagggctggcctaagtcaggcagttcaagataacctgaaggagtcgaataacatctatccagtgagtcctgcaagacttcaggctctttctcagccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagagagagagagaggagaaagtgagctcagcgaattggccgggtgacacactgatgaaggggtcaaaggacactctgagttagtgccctcgggacacacagcgaacagtgatcatgaaaagagtgggctcaataattttccataaacttgctcaagattccatgcagttgccatacggcctttgaggtatggtcaacctatagtaagttagtaaatgacaaggggaggaagaaatggaaacctaaacatctactgcaatgaaaaccaacagcaatgtcagtgggagtaattcaaccttcgtggaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatatgaagctggttctcctacacacataacaatccactgtctaatcctcacacagggacttcaggctcctcagcatgagaataggacactgtgagagatattcttcaggaggcctgaaggctgatcatgatagagattccttggtttttgtcccagaaactctgggtaaacttccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcatggtagtgaggattttagatgctgaaagtagagtgaaggatgaaatctacaagatctacagaattgagacaaaatcagagttgtgtgaatttgtcacatctgcccagatccaacatcttgagagtaggattagggtgccacaggcatggcctgagactaggaagagagccttgctcactgacccatcccttgtctgggcttccaagtggaactagagtttcactcaacctacatgtgcctataggtcctccctgtggcaatgacatctctcagctcagtaagggccacttgcagtaggaatatgaccctaaacagaagactcagtggatacttatcaccttcatagaaaggtactcaccatccatgtcaacagccaagccaatacgctgttgctccaatacgtaaaaggcacttctgtagggctggcatgagtcagtcagtccaagataaactgaaggagttgaataacatctatccagtgagtcctgcaagacttcaggctctttctcatccagcagctccctgctgagcctggaaaagtgggaaaaagtaaagaataagccagggggaatcagaaaccacacagccccagctagatttcatggctaacatgaggaagagtttgaaaagaaaaaggacagatccattaatgaggtaacaaattattgcctttatgttgggatagactagggccaggtagaaaaggatgaaagagaaagacacacacacacacacacacacacacacacacacacacacacacacacacacagtgtgagctcagtcaattggccaggtgacacactgatgagggagtcaaaggacactctgtatttgtgctctcaggacacacagtgaacagtgatcatgaaaagcatggcctcaataattttgcataaaatgtgctcaagtttccctgcagtcaccatgagaatacagcttttgaggtatggtcaaccttcactaggttagtaaatgataagggtaggaagaaatggaaacctaaacatttactctaatgagaaccaaaaaacaatgcagtaggcataattcagacttgtctgacaagacaaaatcattattttcagcgtgtactgttttccctggacttggcatctccaggtgtcaacatcaaattaactgtccacaatttctcagactcacctgggacctgttgcctcttggtcctcctttttcacttgatcccaccgatgtcctgcaaataaattcagatggggcctcttacattaagcagttcttccttgcacacagaaacattcctctgtccaatcctaacacagggacatcagtcttgtcagtgtgaaaacaggagactttgagagaaatattccagtaggcctgaggtcaagtcttgagaaaactggcttgggttctttcatgagccttgggcaaaattcccctgtgttggaatgttattttccctatgtgctctgtcctaggtttatgtacacaaatgagcaattttttccccaataaattgtaggcaaatagttctaacacctcataggagagatacttcaatattaagctttctctcatcaaatacccagaatttgatagtttatgagattgtggacacagagatttgatgaaggggtgcaatgtaccagctcttgagtcaaaatgaaacttggttctacacagaagcatcagctattatggcttttgtgggtgaaaagtaagccatttatctagaaaacataccaggaacatgacggacagatgagctaaaacaagcgaacttagaagacacagaaaatggggataaattcagtgaaacctgggtcacatctttcactgagaggtagacaagggtgacactggccttgggcaggtaaagaaccacacagacatgctttgggaacaaaactcataaggaattttgtagctggcaagagacatttaattcagatgagctgatctgacagacaactcctgggcatgtgctgcacagtttggtgtgagtttgccacacctgccttgagttcaatgtcgtgacagtcagtccaggttggcatgggcatggcctgagactaggaagagagcaaagctcactgacccaccccatgcctgtgcttcagactcgactccagagtgattgaaatctacattgatatataggttcagcccacagtgatggcaactctcagcccaaccaggggcacaaggcccaaagattatggggtctacctgggccatgaactggagctttatcaccttcacaatggagtactcactgcctatgtcaacagccatgcagacttgctgttcctctaatgagtgaaatgtgctgctgtaagactggtacgaggccaacctttcaggaggaattgagagagtcgaataaccttcatcccaggactcctgggggacttcctcctcttcagactcctgcagattcctgatgagccaggcaggacagggatgatagaagatttaaccaacagacattagacaacaaaacctcccagatgatctgatgggagacagaatggagtggtcacagaaaccaaaggcatttttccttcaagagaaataaaactatccttctaaatacagggtggagggtgactgctctggggacagagcaaaaatgggcagcatgtgctcagtacatttgccacagatgagccaactcagggcacccagactctccctgtaaactaccatcatgacttgcagcacagagaactgacacagggcttcaactactttgcataaattgggttgaattttacacgcagcattcaagtgaagagagttcttgacgcagtgcagacacagatcttgtgtattaagggccccattttcccaatattttgatataatatatttactttttcaatttcttttcttgcaaaaatactagccaacatactaccaacaaatgggaagaaagcatatatacatctctccctggatttaaacacatgggagagaataggcgacaccaagaaatctctgtttgagggtctggagtggacttccagcaaactccaacagacctgaagctgagggacctgactgttagaaggaaaactaacacacagaaagggatagcatcaacatcaacaaaaaagacatccaccccaaaaccccatctgtaggtcaccatcatcaaagaccaagggtagataaaaccacaaaggtggggagaaaccagagcacaaaagctgaaaattccaaaaacctgacatcccttctcctccaaaggatcgcagctcctcgccagcaatggaacaaagcaggatagagaatgactttgacgagctgacagaagtaggcttcagaaagtcggtaataacaaacttctctgagctaaaggaggatgtgcgaactcatcgcaaggaagctaaaaaccttgaaaaaagattagacgaatggctaaccagaatgaacagtgtagagaagaccttaaatgacctgatggagctgaaaaccatggcacgaaaactacgtgatgcatgcacaagcttcagtagccaattcgatcaagtgcaagaaacggtatcagtgattcaagatcaaattagtgaaatgaagcgagaagagaaatttagagaaaaaagagtaaaaagaaatgaacaagcctccaataaatatgggactatgtgaaaagaccaaatctacgtttgattggtgtactgaaagtgacggggagaatggaaccaagctgggaaacattcttcaggatattatccaggaggacttccccaacctagcaaggaaggccaacattcaaattcaggaaacacagagaacaccataaagatactcctcgagaagagcaaccccaggacacataattgtcagattcaccaaggttgaaatgaaggaaaaaatgctaagggcagccagagagaaaggtcggattacccacaaagggaagcccatcagactagcagcagatctcttggcacaaaccctacaagccagaagagagtgggagcaatattcaacattcttttttttccatatgtatagttttcctttattattttttgtgtgtatgtatatatatatattttaatactttaagtcttagggtacacgtgcacaacgtgcagcttagttacatatgtatacatgtccacattggtgtgcttcacccattaactcatcatttaacattaggtatatctcctaatgctacccctcctccctccccccaccctacaacaggccccagtgtgtgatgttccccttcctgtgtccatgtgttctcattgttcaattcccacctgtgagtaagaacatgcggtatttggttttttgtccttgcaatagtttgctgagaatgatggtttccagcttcatccatgcccctacaaaggacatgaactcatcattttttatagctgcatagtattccatggtgtatatgtgccacattttcttaatccagtctatcattgctggatatttggcttggttccaagtctttgctattgtgaatagagccgcaataaacatatgtgtgcatgtgtctttacagcagcatgatttataatcctttgggtatacacccagtaatgggatggctgggtcaaatggtatttctagttctagatccctgaggaattgccacactgccttccacaatcgttgaactagtttacagtcccaccaacagtgtaaaagtgttcctatttctccacatcctctccagcaccttcaacattcttaaagaaaagaattttcaaccaagaatttcatatccagccaaacaaagcttcataagtgaaggagaaataaatcctttacagagaagcaaatgctgagagattttgtcaccaccaggcctgcccaaaaagagctcctaaaggaagcactaaacatggaaaggaacaaccggtaccagccactgcaaaaacatgccaaactctaaagaccattgacgctaggaagaaactgcatcaactaacgggtgaaataaccagcaaacatcataacgacaggatcaaattcacacataaccatattaaccttaaatgtaaaggggctaaatgccccagttaaaaaacacagaatggcaaattggataaagagtcaagacccatcagtgtgctgtactcagaaaacccatctcacatgcagagacacacataggctcaaaataaagggatggaggaagatctaccaagcaaatggaaagcaaaaaaacgcaggggttgcaatcctagtctctgataaaacagactttaaaccaacaaagatcaaaagagacaaagaaggccactacataatggtaaagggatcaattcaacaagaagagttaactatcctaaatatatatgcaccctatacaggagcacccagattcataaagcaagtcctgagagacctacaaagagatttagactccacacaatcatcatgggagactttaacaccccactgtcaatattagacagatcaatgagacagaagcttaacaaggatatccaggacttgaactcagctctgcaccaagcagacctaaaagacatctacagaactctccaccccaaatcaacagaatatacattcttctcagcatcacatcacacttattccaaaattgaccacatagttggaggtaaagcactcgtcagcaaatgtaaaagaatggaaatcacaacaaactgtcagaccacagtgcaatcaaattagaactcaggattaagaaactcactgaaaactgcacaactacatggaaactcaacaacctgctcctgaatgactactgggaaaataacaaaatgaaggcagaaataaagatgttctttgaaaccaatgagaacaaagacacaacataccagaatctctgggacacatttaaagcaatgtgtagagggaaaattatagcactaaatgcccacaagagaaagcagaaaagatctaaaattgacaccctaacatcacaattaaaataactagagaagcaaagcaaacaaattcaaaagctagcagaagacaagaagtaactaagatcagagcagaactaaaggagatagagacacaaaaaacccttcaaaaaatcaatgaatccagggctggttttttgaaaagatcaacaagaaaaccctgtttggctagttcacctggctcatctgatggcaagttcctatcttgagaggactatgaaattaaaaccaacacaagtgccacaaatgacatacaacattgtaaatcagcacaatttgtagctgggtgaatggaagaaatagttctattcatcacttcctcattttccctaaatctacaatctccagatgtcactactgaattaacagccaacaattccacaacattacctgggagacactggccctttttcttcctcttcctcatcatcactttcattttctgtaaataaattcagagaagcaggtcacattaagcaattcatacttcacatatgaacaaatcactgtccagtcatagcacaaggacataactattctcagtgcaagaataaggattctgacaggaatattctagggtgccctagattaactttggtgagaattagatgaccctgctttccagacccacaggccaaaatctccctctacgtgtagaccataatgccatattccctgcctgagtcaaagttaaacaaaattttttccccaaaaaaatctccaaaaattggtcaaacaattttctaagagtgttgctgcaatacggacttatatcaccaggtaacatggacattaaatgtttagaggcatctatacatgaaacacgactgatagataaatttgaacaactcttgctttaaaaagcatctgtgatttgggaggccaagacaggtgaatcatttgaggtcatgagttcaggactaccctggccaatatggggaaaccctgtctctactaaaaatacaaaaattagccagatgtgatgttgtgcacctgtggtcccagcaactcaggaggctgaggcaggagaatcacttgaatctgggaggcagaggttgcaccaagtcaagatggtgccactgcactccagcctaggtgacagagcaggactccatcgcaaaaaaaaaaaaaaaaaaaaaaaatctacgacgctacaaagaaacattggatcagccattgcattgacagggtggagaaccagggtccagccttgctttatggaaatatatcagcaaagtaaagaagaaaagtttccatcctgatttcagggtgactgtgcagctaagcaagctgacttaaaggagatccagatgaaagctgagagcagtgaaacctggggaacaatatttccaaatacaaaggcaaggctgccagcttccttaaacaggcatagaaactccatggacattgttcagggacagatgactaaatcacagatgacaagagatactgaatcgaagttaggaggcctgacagatactgcctgtgcacctcctgcactgaggtgactatgagattgtcacacttgcctggggtcgagtaacttgatactggggactggcaaacaaaggcatgacattagctgagaaggacaaaaaaactccctgatatctgtttagaaacccatcacagttttttattcaaatgaatttgtgtttatagagcctgtcttcagagtttatcttcctcagcctagagagaggtatgagacacaaggaaaacagaggctacctgggataatgtgtacagcatcctcccattcaacatgagaggatgagccaatgagagttgagtcgactttgtcttcctcaaatgtgattttggtttttctatgtggctggttggagtcataagggccatggctatttgaacaagtgatggcacactcctccagtgagtcctcagggacttccttttcttcagccttctgcatctccctgatgagccaggtgggacagagatgacagaagattaaacacagagggattggaccccagggagtcctagctggttttgacaggcggcattaagagagtggtcccagaaagcaaaatggacgttcccattaagagggaacatgcaatcctgttctgtctgcaacagagcatggctgccatgggaaccagagaggaagagagcagctgctgttcattgcactggacagataggagctgaggaggatgaagactcagctatccctgtacggtgcagacatgacactcggcacacatagagaaacatgacagctgccgcaccctgtgtctaagctgggttatatttcacatactgtggccaagcgaatgcgggtttttggcccatcatacatgccagagagggtgtgcctcctagatattcttcatatgttaccatccattaattgttcctgagtattcagtgttacctgggggaagacgatttctgcactttctcagccacctcaacttgaacatcttcatcgtcatcgttatcattttctgtaaatacagaagtgttcattcagatatttcccacttcacagtctgcaagcacagtcagcccaatgtgcaacagggacatgaacatctaggcatgggtcaccgttcaactgaaaactctcatgttttatctttaacagaatgccctggcatggtttcctggtccatcaggcaatgcatttctgatctggagggccaccatcaagatgtggccaaatattgaaaagaccttttgcttcccatatcactggaggcttgtgcagcctctctctggactttggcagctgtctcccccatcctgccagatctgattcccaggcacaggcttggtgtcctgtcacagtttgcatttcaaacctaattctttctcttagaagcaaacttgtcccacagtcctctatgcatcagaagatttcaagcctccaagtggcttctgctgtgttattcagggacattctatccatggggagtgctccagtctgaagcacttcctaccacaaaatgcccccacatcaagtgccttctccaacaccacacggagaggggcttcatctcattttggaaagcagttgtaagtgttcccacatttgaatgcttcagaccttgcaagagacaatttgtctgccatggagagagagaaactcaggaaggacaagtcattcactcaccgacagttactaagaacattgccaaaaagacagcctgggaaccttcattcttagtccagagctcttttcactctaacaagcctgctcccatcgcagcctccttcctgtcctttaaaactagacagatgctgcctcttactccaaagaccaccttccatcaaggaaggagggacacttgcaatactgtgacctccaaccccatgggtttcccatctccgttcttacccaggaagtcctggtcatgtcatggccacataagcttagtggaaaaaaacaccattgatacaactgtcattgtgaaagtatggaggtctggagcctctcataagcctggggttttgggtcatcagggcctatggccaccttacctgggctgagcttttggacaaggtgctgtgccagtctacacccctcagccagctgttcttggaggtcctgcccctgggacttgtccggctcatccggagtgaggagggcctggagatgctcattcaatgagcgggaggcatctctcccttcccgtaacttctcccttaactgggtcagctctcgttcctgagagtgaaccaggactttatattgcctaaggtgagacggtagagaaaatttaagagtggaaagggttgagtgatccgttcaaatattgcaacagagatttctgagacaatgtcctcaaggagacctccaagcagaaggtcagcacatgttgaaaggaatgtctgtggccaagagaaagaatagaaaatggtttacaggcttcctctgtatcagagagggctcctgcaagatcctcgatgatgttccattcatctttccttctgtaaacaaaagtaggtgtcttcctaattccgtttcaaaaagacatcctttcagttcctcactctggccatggacatttccatgtgaaaatacacatagtgcatcttgcggccattagatacaaagccatgtacagaaatgaggccagatgcagatagggcgaattgaaaagacgaaagaagaaaagaatgacagggtcgagaaggcaacattgattgagtgaaagaatgagaagccgcagtcagtcaggaggtgattctcactagggtaagtggggtggtgatggcacaccattttgagtatactgaatgctgctgtgtggttcacactcctttggttaattttgtgttatgtaaatttcacatcaacaattacttgtttgaaaaagagaaaacaaggctctgagaaacaactgcaacccataaatttttattatccttcttctctgtttgataaatatttgtgtgtagcaaacctgccatggcaattcctgcccttcccctggcccagcttagctcttacgtctccccactgagctactgtacttcagagatttacacacctgcccccctgcctgcccccatggggtcccctcacctgagctcctcagcttgcttcagctgctctgcaagcttctcctccttgaactgtcgctcattcctcagcatagattttatgaggtctttgcactcttcatattctgagaaaagacagacacgcctgcatcagtggaaggctggacatgctgctgtggtcattgcctacagggcaggagccaggtccatcccaaggacaaaactctccacagtaccagggtctagacagggatttccacgtctttactcttcagtctcctgactttctggcatctgatcctccaaaatttagagatgaagaaagagaaactcaagggcacatcaaggaagttgacaagatgattcaaccacaacgaagtggagtcagaattcacagtccctgaggtctgactctgaattcggggccactttcccaagacttgcagcctctcctctaaaacactgcactggggcatgaagtagtgatttcttgtacagtcgggaaggcccctaggactatgggactgatggtttcccttttactgggaatttcaaggacaagtatgtgaaagattttaaaaatctttgattttttaatcatatcttcagttatgattttaagaatcatatctgaagcataaagtgtgacacataacaccataaggccatgaaggaaatcctatgcccaaatgctaatgaagtttctgttaatttagaaacagcagaatgaagaactaatagatagtgtttactctgtgccaataaacgttctaggagattgacaagaaatagctcatgtaattcactgcagcaatttacagaggtaggtattattgtagtaccctctgaacaggtgaggaaactgagggacagagaagacaagcaccttggatggagcccaggagacaggcccacggtccctgctctgtacactgcactgctacctccacacattctcgggtgcgatctttcttcctctttaggaacaagactctgtgccccaggaagcaggacttcactctcaccaagctactctctgctttttattcttatttttatttatcattattatttttttttaacagtcttgccctgtcacccaggctggagtgcaacggcaaaatcttggctcactgcaacctcagcctcctgggttcaaaggattctactgcctcagcctcctgagcaggggtgattacagtcacctgccaccacgcccatctactttttgtatttttagtggagatggggtttctccatgttgcccaggctggtctcaaactcctgacctcgtgctctacccgcctcagcctcccaaagggctgggattacaggagtgagccaccatgcacggcccctactccctgctcttgatgctgtcacttatagatagcacaggttctattaggagcagactcctcttgaagcccctcagagcgggtactggctactatcaccaagtttccctcagagtcactagaacagagctttgtgtattgggcctcaacagaaacttgaactgaataaaagttcactagtctcagatatttagaacaacagactagatgttatttgtctgcaggatcttatgtggtacagagaggattcttgaaaacacgattgagcctcttggagaaaacaggtcattctgtgcctgtgtcagaaatcaataaatggcagtttaactctagtcccacccccacctgattgcaaacatggaaagttgctaaatactttggtacctctgtcttccaactttaacaaaatgttaaaatacccatttctgttttcctagaagtatggggaggatgacattatttttgatggagagagcacttagtttctcagagagaagacaggacttcgttcatcactttcgtgatggtgagcatatagatcttactgtatttgttctgctgcttggccaggaagcaggccacttgagttacaaaacatttctctttgaggcttctgaactgctgtttcttctctgccagctgggggcacaatttctcattgatttctagaatgttcatctctgccttctcgctggacaaagggccggctgataccaccatgctgacgtttgtggcagaagaggtggggccagggactggggagaagaaaggcaaacatatgatgggttaaaaactggtgaaatcaaataggcttaatcaggactgagggatgtcactggtagccttgtttacttatttgaagatgttgtttccctggtttcactcttgtcatctccagtcttgatctcctttaagtcaacttgtcttagctatgcagtcaccttgaaaccaagacataaacacttctacacttgcttatacgtttctataaagcaaggcttggccctgagatttttatcccatgagtggccaatgtttctgtgtagcacaaaagatttcattttgctttttaaattttttccttttttggttttttgttttctgtttgagacggagtctcactctgtcgcgcaggctgcagtgcagaggcacaatctcagctcactgccacctctgcctcccgggttcaagcgattctcatcactcagcctgccaagcatctgggattacaagcgccaagtaacatgacagctaatttttgtatttttagtagagatggggtttcgccatcttggacaggctggtttcgaactcctgagctcaggtgttccgcccaccttggcctctcaaagtgctgggattaagatgtgagccagcgtccctggtcagagactttttttttttttttttgagatgcagtctcactctgtctcccaggctggagtgcagtgccacagtctcggctcactgcaagatccggttcctgggttcatgccattctcctgcctcagcctcctgagtagctgggactacaggcgcccaccaccgcgcccagctaatttcttttttttttgtatttttagtaaagacggggtttcaccgtgttagccaggatggtctcaatctcctgacctcgtgatccacccgcctcggcctcccaaagtgctcggattacaggtgtgacccactgcgcccagccaagacttattaatagctaagacaagccaatgaaaaggagagagagtctagcctgacagaagtgaatgagggtgggaggatcatctcagcccatcctcccacctaagtctcctgagcagttgggactataggcgggcagcaccatgcctgcctaattttttgtattcttcgtaaagatgggtttcaccatatactccaggctggtcttcaactcctgaactcaagtcatcctcccacttgggccttccaaagtgctgtgattatatgtgtgagtcacagcacctagctccatcctagtttctgactaaaacaataacaatatgtgtatatacagcctgtcctcagaattgatcttccatagcctagacagaggtatgagacacaaggaaaatagaggctacctgggagaatgtttagagcatcctgacatccatcatgagaggattctctgtctacaaccagagatgagttgactttgtcttcctcaaatgtgattttgatgttcttgtgaggctggatggagtcacaagggccgtggctatttgaacaagtgatggcacattcctccagtgagtcctcagggactttgctctcttcagccttctgcacctccctgatgagccaggtgggacagagatgacagaagattaaacacagagggattggaccccaaggagtcctagctggttttgacaagcggcattaagagagtggtcccagaaaacaaatggaggttccctttaagagggaacaggcaatcctcttctctctgcaacagagcttcgctgccatgggagccagagaggaagagagcagctggtgttcagtgcactggacagataggagctgaagaggatgaagactcagctatccctgtatggtacagacatgacacttggcacacatagagaaacacaacagctgccgcaccctgtgtctaagctgggttgaatttcacatactgtggccaagggaatgcgggcttttggcccatcatagatgccagagagggcgtgcctcctagacattttcatatgttaccacccattacttgctcctgagtattcaatgttacctgggggcagatgattccagtactttctcatcctcctcaacttgaacatcttcatcctcatcttcgtcattttctataaatacaaaatgttcgttcagatatttcccacttcacattctgcaagcacagtcagcccaacgtgcacagagacatgaatatctatgtatggttcagcattgtactgaaaactctcatgttttatccttcacaaaatgccctgatcaagatgtggccaaatactgaaaagaccttttgcttcccatatcactggaggcttgtgcagcctctctctggactttggcagctgtctcccccatcctgccacagatctgattcccaggaacaggcttggtgtcctgtcacagttcgcatttcaaacctcattcattctcttaggagaggacaaacttgtcccacagtcctctatgcgtcatgagactgcacaggccctccatgtggcttctgctgtgttattcagggacattctatccatggggagtgctccagtctgaagcacttcctaccaccaaatgcccccacatcaagtgccttctccaacaccacacggagaggggcttcatctcattttgaaaagcattcgtaagtgttcccatatttggatgcttcagacccttgcaagagacaatttgtctgcctttgcagatggagagagagaaactctggaaagataaatcactcactcaccgacacttactaagaacattgccaaaaagacagcctgggaaccttcattcttagcccagagctcttttcactccaacaagcgccctcccatcacagcctccttcctgtcctttaaaactagatagatgctgcctcttgctccaaagaccaccttccatcaaggaaggagggacacttgcaatactgtgacctccaaaccgatgggtttcccatttctgttcttactcaggaagtcctgatcatgtcatggccacatatgtgtagtagaaaaaaaccccactgatacaactgtcattgtgaaagtatggaggtctggagcctctcataagcctggggttttgggtcatcagggcctatggccaccttacctgggctgagcttttggacaaggtgctgtgccagtctacacccctcagccagctgttcttggaggtcctgcccctgggacttgtccggctcatccggagtgaggagggcctggagatgctcattcaatgagcgggaggcatctctcccttcccgtaacttctcccttaactgggtcagctctcgttcctgagagtgaaccaggactttatattgcctaaggtgagacggtagagaaaatttaacagtgaaaagcattgagtgatccgttcaaatattgcaacagagatttctgagacaatgttctcaaggagaccttcaagcagaaggtcagcacatgttgaaaggaatgtctgtggccaagagaaagaacagaaaatggtctacaggctttccctctatcagagagggctcctgcaagatcctcgatgatgttccattcatctttcccttctgtaaataaaagtaggtgtcttcctaattccgtttcaaaaagacatcctttcagttcctcactctggccatggacatttccatgtgaaaatacacatagtgcatcttgcggccactagatacaaagccatgtacagaaatgaggccaggtgcagatggggcgaattgaaaagacgaaagaagaaaagaatgacagggtcgagaaggcaacattgattgagtgaaagaatgagaagacgcagtcagtcaggaggtgattctcactaagggtaagtggggtggcaatagcacaccattttgattatactgaatgctgctgggtggttcccactcctttggtgaattttgtgttatgtaagtttcacctcaacaattacttgtttgaaaaagagaaaacaaggctctaagaaacaactgcaacacagaacttattattatccttgttctctgataaatatttgtgtgtcatgagcctgccatggcaatttctgcccttcccctggcccagcttcgttcttacttctccccgccgagctgctgtacttcagagatctacacacctacctgcctgtctccccctacggggtcccctcacctgagctcctcagcttgcttcagctgctctgcaagcttctcctccttgaactgtcgctcattcctcagcataaattttatgaggtctttacactcttcatactctgagaaaagacagacacgcctgcctcagtggaaggctggacatgctgctgtggtcactgcctacagggcaggagccaggtccatcccaaggacaaaactctccccagtaccagggtctagacagggatttccacatctttactcttcagtcttctgactttctggcatctgatcctccaaaatttaaagacgaagaaagagaaactcaagggcgcatcaaggaagttgacaagatgattcaaccacaacgaagtggagtcagaactcacagcccctgaggtctgactctgaatgcggggccactttcccaagccttgcagcctctcctctaaaacactgcactggggcatgaagtagtgatttcttgtacagtcaggaaggcccctaggactatgggactgatggtttcccttttactgggtatttcaaggacaaatatgtcaagaactttaaaaatatttcatttttaaatcaatattcagatatggttttaagaatcatatctgaagcctaaagtgtgagacataagacaataaggccatgaagaaaatatgcccaaatactttattagtatgagaggcagcattaagatttagattagttgtgttaatttagaaacagcataagattagtttgtgttaatttagaaacatcagaatgaagaactaatagatagtgtttacactgtgccaattaatgttcaaggagatcgacaggaaatacctcatgtaattcattgcagcaatttacagaggtaggcattattgtagtaccctctgaacagatgaggaaactgagggacagacaagacaagcaacatggatggagcccaggagacaggctgagggtccctgctttgcacactgcactgctgcttccacacgttctcgggtgtgatctttcttcctctttaggaacaagagcctgtgcaccaggaagcagacttcactctcaccaaggtactctctgctttttatttttatttttgatttatttatctttttgtttgtttgttttttgacgagtcttgccctgtcacccatgctggagtgcaatagtgcaatcttgactcactgcaacatctgcctgctgggttcaaaggattctcctgcctcagcctcccgattagtggtgattacagttgcccgccacgacgcccatctactttttgtatttttagtggagacggggtttctccatgttgcccaggctagtctcaaactgctgacctcgtcctctgcccgcctcagcctcccaaagtgctgagattacaggagtgagccacgttgcacggcccctactccctgctcttgatgctgtcacttatagatagcacaggttctattaggagcagactcctcttgaagcccctcagagcaggtactgggtactatcaccaagttcccctcagagtcactagaacagagctttgcctgttgggcctcaacagaaacttgaactgaataaaagttcactagtcctagacatttagaacaacagactagatgttatttgtctgcaggatcttatatggtacagagaggattcttgaaaacatgattgagcctcttggagaaaacaggtcgttctgtgcctgtgttagaaatcaataactgtgagtttaactctagtcccacccccatctgattgcaaacatggaaagttgctaaatactttggtacctctgtcttccaactttaacaaaatgttaaaatacccatttctgttttcctagaagtacaggaaggatgaaattatttttgatggagagagcatttagtgtctcacattcatcactttcatgatggtgagcctatagatcttactgtatttcttctgtcggttggccaggaagccggccagttgagttagaaaacatctctctttgaggtttctgaactgctgtttgttctctgccaactgggggcgcaatttctcgttgatttctagaatgttcatctctgccttctcgctggaccaagggccggctgataccaccatgctgacgtttgtggcagaagaggtggagtcagggactggggagaagaaacccaaacatatgatgggttaaaaactggtgaaatcaaataggtttaatcaggactgagggatgtcagtaactgaaattcttaacttactgttgtgaaaaatgtgatcactccccacagcactttaggatccttcaccacaaaaacaaggttcgaggtgcctcaactcagagctgaaagcactgctcagactctgataagagtgaggtagattgtggccagcgtgccaggtaaccgtctgcagttgcaataacagaattagaaggtaggggtgtcatggaatcttaggagccctgcattccaattgcccaggctttgctgaaacacaggcaccctagtctcacctgagggtcaccaccaatggggatcattccttcagcattcactctcagtattcgtgtacccttgtgacaatgccacagacccgtgtctttcccaatacatctaagcatattcctcactgtttatctcttgtctgtacaacatcatcaaggcagaaacagtttcccaacaggttatattttcttaatggtagtcatgaagtcataaataaaaaaatggaatcatttagtatgttctcttgttttgacttttttttttttttttttttgagacagagtctcactctgtcgcccaggctggagtgcagtgacgcgatctaggctcactgcaagctctgcctcccaggttcacgctattctcctgcctcagactcccaagtagctgggaatacaggcgcccgccaccacgcccggctaatttttcttttttttttttttgtatttttagtagagacggggtttcactgtgttagccaggatggtctcgatctcctgacctcgtgatctgccgcctcggcctcccaaagtgctgggattacaggcgtgagccaccgcacacggccgacttctctttactcaggtgggtatatatgccactaatttgtttgattgtgtttttcccttgtttcattttgttttggccaagtaatatcctattgattgtatgattatcacacaattttatatccatttttctgatgggagacaggtttacttgataactactgtgcataagtaactatgaatattctcatacaattatttctgtgaagatacatacttattttcctgggtatctatagctagggatggagttgcttggtgaatgggtagaaaatgttggacagagttttgcaaagtatttgtattgttttacatttctatgaaagatgtaggccatttccagttgctctacattcccacacacttaatattttcagtcttttaaactatgccaggtgtgtagtgatatcctaaaatttggttttctcatgcctaatgttcatttagatatcttcttatggaaaatatcttctcaaatttttatattcattgatatactgggctgtttgtcaatttctttgtaataggagttctttatatattttgaatgagtccatttatacatacatattttttgctgtattatatagcaaataattattcctggtctagagatagcgtttaagttgttaaacaacaacataataaggagaagctttttaaaaatgaagtgcaattcgcttgatttcttattgtggtgagtgctacagtatctagtctaagaaatattttcctgtgtcaagttcatgaaactatttcctatttttcctttacaaggtttctaattttaactttcacatcttaagttaatttcaatatatgatggagagtggttaatattaactttttaaaacaacaaatattatttcactcaaaatcgttttacttaaaagtctttcatttccccaatgaagggcattggtgtctttgtttttaaaacatttagaagcggcggtgcgagcatgttctcactcatgggtgggaattgaacaatgagaacacttggacacagggcggggaacatcacacaccagggcctgtcatggggtgagggctgggggagggatagcattaggatatatacctggtgtaaatgacgagttaatgggtgcagcaaaccaacatggcacacgtgtatatatatatataatatatatacacgtgtatatgtattatttatatatacacatgtatatatattatatatatatacacatatatacatgtatacacgtatatataaaatatatatacacacacgaatatatattatatatacgtgtatatacatacgtgtatatatataatacgtgtatatacataatatacaatatatataacacgtgtatatatatattatatatatattttttcttttttaagtggcggagcgagggctactgcacagctagcagagtcgtggcgaggaggacagcacctgcatcgagctctccgcctccccaacccgccagcccaggcggccccagcagcagcgaccagaggagcccctgcagcaacgcaaaggccaggtggacacctccatctacagcctcgtggcggacgggacctgttaggacacggccattgtgggcaacaaggacccaccttccatctgtgccaccgtcccagggaaaaccttcctcaacatcacgccagctgaggttggtgtcctggttggcaaagactggtcaagctttgtcatgaatgggctgacactggggggccagaaatatactgtggtcctggactcactgctgcaggatggggaattgaccacggatctttgtatgaagagcatcggtggagcccccaccttcaacgtcattgtcaccatgactgccaagacgctaggcctgctgatgggcaaagaaggtatccatggcaatttcatcaacaagtaatgttatgaaatggcctcccaccttcagcgttcccagtactgacctcctttgttccttccactccaccgctccccacagctttgcccgcctttccttcacatacacacaccattttaatttcaggagtcattaccccacacaccttattgctgccaaaaccacatgggctgggggccagggatagatggacagacaccttcccccacccatacccctcctgtgtgtggctggaaaacttttttgttttgatggattttttatgaataaaaaagattctactaaaaaaaatcaataactgtacatatgtgggcatattgtttgaatctgtattcttttgctttgatatatttatgaatacttacaccattactactgtttttaaattactgtagctttaaaatcaggtttgaaatctagcagagcaagtcctccaacttattgcttcttcaagaccgacttgcttattctaggttctttgattttcaaatacattttgaaactagctttcaaatttctctaaaatctcctactagaaatattaatcagaattgtgttgatgtaatatgctaacaaaattgagtcttccaatcaatgaacatgatatatatttatttagccttctttaatttttctcaccaattgcttttaggggcctcgtacctgcttcattgcatgtattgttaagcatgtaatgattctggctattaatctctattatgttttattgaatttcattttctagctgctaattgctagtatggagaaattaagatgatgaaatcaactttataaaggcataatttcggtacaacagactgcaccactttaaaatgtgtaattcaatgcacgtttacaaatggatgcactaacggaactactgccacaaccaagatagaggaaattccctatgcccaaaagtttcttgtacccctttgcagttcatcagcctttcaaccctcagccccaaggagccactgtcacttcaggtccgtttgcatttttaaccattttctataaatgaaatgatacctgtgttcttttgtgtctgccttctttcatgcatcaatgtaattttaaaatccatctgtaatgtcttgtaaatactgagtagtattccttcatgtggctataccatgtatgtttgtactttcacttattattggacatttctatcattccacgtttgggctattatgaagaaactatcatgagcatccatacgtagcaggccaggtctcactaacacaggcctccctaaaaactgtttcagtagcgactgagtggttcaattaaatattaagaggaaaaaaaaaaaaaaaagaagccagtgcccttatacaaaggctggaatgtaacaaaagcccaccaagagttttgcctaggtttttcctgggccttaaagcatgacgaaataacgaaggcattcttaacaggagccatttagtattaaacgagttttactgggggtctgaagaaactccccaggcctccacagacaagtttattggagatctgaagggactctccaaacctctgtgatttagcaggagacaagataagggcccccagcacctagacccatttagattaagtgaatttaactgaggttccagaggaaggtctttaggactcagacttagttatagattaaaagaagttaatcacttatgtatttagatgaatgcacacttccacatacacatatagcttagaaggtacattagctcaggaaaactttccaattttgagttggtctggtgataatttccaggccgtttccctgtaaccagttgcagaagtcaaaactctcttcctccccagttcatctgtgtctcgttactgagccacgagaaatagcagcccgcccctcaggttggtctggaaacacacatacagatcattgtgcagacacagtgtgtaaattcctaggaatggaatgactgtctatctgatttgtgttatgtttaacctttaagaaactgttagattttcaaaggagcaataccatttttcattcctacaagtataagacttccaagtgctttatatcctcaccaacatgtgctattttcagcctttttaattttagccattcttatggatatgtactggtatctcattgttgcactgattgatctccctgatgactaaacagtggagcatcttttcctatgctaattgaccattcatgtatcttcttttctgaagtatctattcaagtcttttgagaaattgtttcattgtgctgtttatcttatcagactgcaatatatatatgtgtgtgtgtgtatatatatatatatatattccctatttggagatgataatcttcaaaacggtgaatatatatatatatatacacacacacacacacacacatgtttgtgtgtgtgtgtgggggggtgtgtatacatatatatatgtcctaagaatcaattagacatacatgtgagtatctatttctggattctctcttctcttccactgatatatattctatttttttttttcaacaaaacacataatcttgattttcatagctgtagagtaattctggaaataggtagtgaattcattcaccattattcttttataatattgctattttattattcttgatcattgacattaccatataaatggtagaatcagcttgaaaatttctaccaaaatgccacttggaatttttattagaattgcattggatctggagatcaatttacgaagaactgactctttaaacataacaactcttctgatccatgacaaggtttatctccccactaatttagttctttcataatttctcaaagcaattttttgtagtttttggtgtactggccttacataaattttgttgactttcctttttttttttttttttttttttttttttttttttttttttttgagacagagtcttgctctgttacccaggctggagtgcagtgatgcgatctcggctcactgtaacctctgcctcccaggttcaagtgatcctcctgcctcagcctcccaagtagctggactacaggcacatgccaccacgcctagctaattttttgtatttttagtagagatggggtttcactgtgttaggcatgatggtctccatctcctgacctcatgatctgcccacctcggcttcccaaagtgctgagattacaagtgtgagccatggtgcccagtctgttgaatttatttataagcacaacatgtatttagatgttactttaaatgaaattgtattcttatttcattttccaaatgctcattgctaatatacagaaatacaaaagaccacttacattgagagcttacattctgcaacactaccaaactcactgattagttctggtagatttttgtagatttctagcattgttaacaaacacagtcattatctgtgaataaagacagcttcaattctttcttttcaatactttattaatttttcttactttattgcattgacttagagctctagtataatgctgaattaaaagagtaacagcaggtattctacttttttctctgatttaatagaaaagcattcaatcttatgccatttaatataatgttacctgtgggttcttcaaatctgcccttaatggggttggaagtgttgccttctgttctcatcatgctgagcattttctggggtttgtttttataaatcatgaaaaaagttttcaattttgccaaatgcttttactgtgtatgaccacgtaatcatacgagttttctcttttgccctggtaatatataaaatgatattttttaaatataaaaaagaggccgggcatggtggctcacgcctgtaatcccagcactttgggaggctgaggcgggcggatcacacttgtggcagcattgaaggcttcactcttccccaagggatccaatctccccccagtcaagaagctccaggtatctgaactggataccaggtcataaatttccactatggtgactccaacaggtctctgtcctcagaactagagcttttctaattattacataagttgacttcttagtagatttcccatccattacatcccagacacctcacaatgattagtaaccaccacatgtccctgcctctcaaggaaatccctcccgccttgtctctagacagccaagtcccacggcctgtcctctactcttccagaaccctgttgttctgacagcagggagggcaaatccatgcagcatctcccgccatgacctccagcctgtagaggagaggcgccacaggacctttacatgcacgccgctgttcccctcacccatgcatttcttaatgccttggtgaggagaatgcctctgggtcttccttggtgggagctaaaggaacaaaggtaaataatgctatgggacccactgagaattggggctgtggaagagtggccactgaagtaatagacagatgcagctattgtcagatactcagtgccagagcagggagggagagggaagaaatacggacctcaccttcctctcacttccaggctccatcgggtgcccacattgctaaacctaactagaagtgtgcacacaggggagccagggatgcattctagaagggacaagccccaagtggcgtaagacaggatggaaatgagtggaaagtggatctgtgggaaggaggaggggatgttatggggaaacaaaaggagaatactagctaataacgctaggtgacactaatatccccaagtctgtgctcatattcagaaaagaaagctcagcataaagcactcaaccaggagtcaagatattgttattttcaactgttgttccaacagttgtattataaagggccagtttatttcatgcctttctaatttgacataaagtgctacatggcattggggctggtacagcctcactcaattatgtgttgaagagtacacagagactgccaggctgagggacgatgcaagagaatagaagagatgctcacagacaaccacagaccacacggccctagagtcaggggcagcaccagccactgtcggctgctcatttgtccagacagagcccacaagcctcaaccatgctttgcttctgcaagatgcttcttcaccttttcaataaacctgcctgaattaaagctgatgggagtttatttctccttcatcataaaagaaattcttcaccacaacaatctccaatgaattgtgggcacagaaggcagacccatccctgcttctcttccactatctcccctgtaggctgaaaaggaggaggtactgaattacctccaaatgttcctctggctctgatattctgtgactctggtttctttttggctactttgtttttggaagcatgtatcctaaggcatcctgttgaaaaacctttgtctactgtgtccagacattcctggtggtatttcagataagacactcttgggttgctgcactcacaagcactgaaacaattctatgaccatctgtttcatggccacctgtttgctcattttctatgtacataaagggaggggacagacagcaaatttgcatattataaattgtatcatcttaaaaaggaaacaaggcaatattttgcaataaaaccttaagatgcattaaatttaagcctaatgcaataaagaatgcccataaaattattatctaaagaatgtttagaaaattgttgaacaagggacatcatcatttaaagtgatatgaagaaaactcagctaagcatatgggctagattagagagaaaaataaaggacacatctctgccctggaaaaactactggtagcatctttcagaaagctctctgtgtttgagtacgcaccttgatccataggctcacatttgatcccaactggcagctgcttcttggcattaactttggattcccaaccagtaaatcttagcaagatctgagtttctccaggtatgatattattttgtttgaccatccttatcttcaagggctaccaagaagaaacaaataatttatttacctccccagaggaaaaggttttaccaatgagacactttcttaccatgaccctgttcacttgagtgccctgtgtggcctgagagaagctcatactggtcacaggattctttacatgattaaactccttcctgaatcccaacttcatggtggtggtgatgacaggtatcccatgctcatgtccctgaagtcatcagcctgtctccagttagaaaaaattacatgtatatagagaggcctctttggaagtagcgaaagctttctcaccttcatacattaatggttggaatgtacaatagtataaacactttgggaaaaaacgtctggcatattcttacagaactaaacaactacctattctatgactcagtaattcctaagcatttatccaagagaaattaaaacatatgtgcagaaaatgatatatacaagaatgtccatagcagttttattcgtaataggaaaaactggaaacattcaaatatctatcaatacaagaatggatacattcttgtattcaaatatctatcaatatacattcaaatatctatcaatacaagaatgtgatacattcattccatggaatggctaaaggaacaaacttttgacacacaaaacaacatggatgaatctcaaaaacattttgagtgcaataggagccatacgcaaaacagtgtgagaaaaatgataaataataatggtttcaagaaatgcagagcagagagcccagaggcaaagacccacaggacagagggtcagtcccaggctgtggatccttactaagaaactcctgcgggattttgcccagctccatttccaaactattttgggttagtgacttctttatcccctccatgttccctcattttgaactagaatcactgtagttgttattctatgcctgtcccatcatttcacattagggacagataagctgtttgttcagtttcacaggtcgacagaggtaagggaattatgtcaaggatctgcacttaatggacactctcggaagcctcattcacacctggtgtggatgttttagatgggattttaagcttttgatctgatgtggtctacatgacatttttcatgttgaactaatgctttaatgacatgaaatctggaaacctcaggggagagggtaaatgcactttgcagatgggggaatgtgagtgtcctactgtggtagatggaatttctgaaatggtccccaaacatgccacacccttgtctctaaagcctcttaaggtgatgagacaccattcctgtgactacattgttatatgccagttatatgactttaagatggtgaggttaccgcatgaactggatctaatcacatcactccatacatgacagagctttgtgtggctggttggagaagatgaagtcagagaaggtgggagcttgagaaggactccataagttgttattggttgaaagatgaaacagacaggtaaggaggaaagcacgtggcctctggagtcagagtagactgtctccccgctgacagccagcacagaaaaagggccctcagtcccccacaaacaagaataggaactctttcattatctgtagtgaacctggaaaaatagcttgagctctaggaaaaaaacacagccagcccattcccggattttagtctcacatgactctgatcagagaacccggccgcttcattccagacttctgtggtttcaaaccactggtttgtggtaatgtgataataggcagcgagagaaaactagtacaggtgcctgtctctcctcttgaatttcaatttcagataaatgtatgctaaccctctaagagaaaaaaatcaatcaatcgaccaatcaatgaaagaactacagtaaaaatattgccctcacctttatgtggctgttccagagcccttgccacctgaagaagacaatgaggggtatttcaggcacttgaggagtgtggctttactgttatcaatcacatttctgaaagaataaaaatggttcagtgaagggatgggttgcccctccacacctgtgggcgtttctcgttaggtggaaggagagacttggaaaagaaagagacacagagacaaagtacagagaaagaaaaatgggcccaggggactggcgttcagcatacggaggacccatgcctgcactggcctctgagttcccttagtatttattgatcattattgggcgtttccggagagggggatgtggcaggacaataggataatagtggagagaagatcagcaggtaaacacgtgaacaaatgtctctgcatcataaacaaggtaaagaaaaaagtgctgtgcttttgatgtgcatatacataaacatctcaatgccttaaagagcagtattgctgccagcatgtcccacctccagtcctaaggcggttttctcctatctcagtagatggaatatacaatcgggctttacaccgagacattccattgcccagggatgagcaggagacagatgccttcctcttatctcaactgcaaagaggccttccttcctcttttactaatcctcctcagcacagaccctttacgggtgtcgggctgggggacagtcaggtctttcccttcccatgaggctgtatttcagactatgacatggggagaaaccttggacaatacctggctttcctaggcagaggtccctgcagtcttccgcagtgtagtgtgtctctgggtacttgagattagggagtggtgatgactcttaacaagcatgctgccttcaagcatttgtttaacaaagcacaccctgaacagcccttaatccatttaaccctgagttgacacagcccatgtcttagggagcacagggttgggggtagggttacagattaacagcgtctcaaggcaaaagaatttttcttagtacagaacaaaatggagtctcttatgtctacttcttcctacacagacacagtaacaatctgatctctctttcttttccccacagttcaggtcaggccatggctcatatctgtaatcctagcactttgagaggccaaggcaggtggatcacttgaggtcaagagttagagaccaacctggccaacatgaagaaaccctgtctctaccaaaaatacaaacattagccaggtgtggtggcaggcgcctgtaatcccagctattcaggaggctgaggcaggagaatcacttgaactcaggaggtggaggttgcagtgagctgagatggcgccgttgcattcgagcccaaggaaaagagaaataactccatctccaaaaaaaaagataaaataaaataaagacggttcactacttaactccaaatattattatgtgaaaatgtatcatctcaattttaataggagattttaaaaaattccttttcttgtgctcaccagacaaggtttggtaacaaataccagtcaccagcacagaagaaccaattcaaggagagccataaacaggactactattatgttcccccgaaaaccatccctagaatgcaatctcttctctatttgtcacaaaacgaacacaatagtccactacataaagtcccaaacacaggaaaatgtaaatataatgaaatctgctttccaaatgtttattctattcagacccagtcatggggaccagggattaggaaatgactacaaacaggttcaagggaatttgggaagtgacaaaatatgctgaagtagaactctgctgatggctgcacaattcgataaatcaacttacatcattgagttgtacattaacaatgggggacttttataacaagtaattctttaaacaaacttttgggtttctatttcaacatggaaagagctaggcagtcatcacttgtcctcacagctagaaaaaagctgaacaaactgaaagtcaacccttctagggtggatcagagaattgaggtcacagggaaaactgccaccttaaaaatgagaaacacaggctaacacataaggagtcacaggtcacagggaagagaagctactggggacagcaagtgggaggagcacttaaatgatattgacaggttactagaagctgagggtagcctggctagaacattaaaaactccttgaagaccagactaagggggaatcttacacatttccaagttttactacaatgatctcaaccaggttctcatgatgaagttcagaaaaactccctgaggtttggcactaccaacttcaggacttacattaagctacagtaacccaaatagtgtgaagttggtcaaaagagaaaacacacacaaatagatgcatggaaaagaatacggagcccagaagcaggcctacatacagtccactgatcttccatggaggtttagagacaatttaaaacagcaaagatagcctttccaactagtggtgctagaacagctggacaaccacatgcaaagaactaaataaatccaggtatgcatgttatatcctttataaaataaatcttacacgtaaatgtaagcgcaaaaccataagaatcctaggagataacataggagaaaatctcggggatcctgggttcaatgatggcttcttaaatacaaaaccaaaagcacaatctactaatgaaaaaaaattaagttgagcctcattaaaattaaaaacttctgttctgtgaaagacactgttaagagaatggaaaaagcaagtcacagactgggagaaaatacttacaaaataatctgatggaaaaactgctgtccaaaatatatgaagaattctgagaactaaacaacacaaagcaaaaaaaaaaaaggtgaaagatctgaacacctcattaataagatatacagatggcaaataagcatatgagaaagatgctcaaaatcatttgtgagggaattgcacattaaaacaacgagatatcaccataaacctatcagaatggctaaaacacaaaacggtgaacacaccaaatgctgtcaaagatcaggaacaaccagaactctccatagctagtggaaatcaaaagtgtagtcactttggaaaacttaagttcattcaaaatcctgcacgtaagtacttacagcaattttatcataattgtcaaaacttggaagtacccaagacgtctttcaccaagtgaatgaataaacaaactgtgttgtagccatacaatgaaatctgattcagggattttacaaaacaagctatcaagtcatgaaaaggcgtggaggaacttaaactacataatgctagaaagaagccagtctggaaacctacatactgtaattccaactctaggacattcttggaaagtcaaaaagatagaagtagtaaaacgatgagtggttgtcaggggtggaggagaggaggaggcatgaaatggtgaagcacagggaattttcagcagtgaaactattttgcatgatgctgtattgaggatttaggacattacgtaattgccaaaacccataatctgtgaaactcaaagaatgaactctaatgtaaactatggactttagttgataatgatgtatcaacagtggttcatcaattgtaacgaatggaccacactaatacaacatactaataggggaaattgtgtgctggaggacaggggagcctaggagaactctctgtactatctactccatttttctgtaaacctagaactgttctaaaaaataacatctattacttttttttaattaggatgcagcagccccataccaaggttttggtggcatcctgttattgtttggttagtacttggcattgaagtgcaccaacctggagtcagagcagttggagatttcaatgcctatgccatttacctctaaccctggggtgcccccggaacacagctagcagatcagttaggcagaagcagcctcagtcatctagacagttcagggttctggtaaggacaggtgcaaaccatctaggtgggcagaacttggtgatgactaggaaccactgagactcagcagctgccccagtggcacccacaaatcagaggaggaggaggctgggaggacctaagggctacaggatgagctccctgcccacaagacagaagcagctccagagattttgataagcaatgtagatttcagtgcagtgtggtctatttaaaatagtagaacaaaaaggaaagaaaaagagagagcatgagagagagagaaagaaaaagaagaaaggaaagaatggagggagggagggaaggagggagggaggaaggaaggaagggagggaggaaggaaggcagggagggagggaggaagggaggaagaaaggaagggagggaaggcagaagggaaggagggagggaaagaataaagagagagagaaagagagtgggagggaagtagggaagggagagaagtagggaagaaaggaaggaaggaaatgaacaaatttacatgaagatgagaacatccaggggaacttacaccaccagtatttccattaacaggaacatgctaactagttattagagagagacgcactactgtaaaactatatactgtttccatggggtacaaccccttcttcctcctctgaaacacattattcctctggcccgctgttgccagagacactgagtcttgtctttggataagttctggtgccccaaagaatgagatgagacagtggatcccagaacaccaggccgcaaccttccctgctgctccttgtccactccagaagctgcccggctgcaggtgggggcctcagcccctgggtctgacatcgtccatttgtcattctcactggacttccctccttgcactggctcccactcccccaggacctggtgggcagccacgtgagaaggatacaaacaggccatgcccctttctttctccccctctcaatgcctgcagtggtgggttccgtggggtagtgacctgagatttactcattatggggcctctagcccagagcagggcatggtacctaatagtcaccccatgaatggtcagtgaaagaaggcgtccaccacaaggtcctggggaaccaagaattccactgtggcccataaattctaagtcctacaggattctggaatgggagatgggatcggccttcaaaagtggtctctcttttaacccattatactggcaactgagccatgtttccccatcctggacacatctagagggcactgcctaaaaccacacacatctccccacccaggacagtgcagagccttagcctgggggatgcgggtggacagggagggggtgagccatgaaagctgaagaggagaaagcaggtgaaagaggacagcagggtggaaacagagagagaaatgggggcagagaatggggggtgagaggggaagagagaggagagggatgcagatctagctaccaaggaaaagtcctgaagagaacatgtcctctcctgaagtaaaatcactttcacccgaccatggcactgcaagtccagggcggcacacgctgtgaatatttgttcattcatttaacatatatttatttaatatctgtttgatgccaggcaaggccctgtgatgtttagggcccttggcatcttcccttcacatctgagtcataatagaaagaggactctctgaccccatcgagctggcaatgcctcaggatttttacctgttggatctggcagctcttcatgtcggcccacaccatgtgaagctgctcttggtgcactgaatgggtaagtttctacatcggtgcctcggagagtccaccagaagccctggacagtgggagttggtggcacccccagtgtggaggccaagagcacacagcactgaagctccagacatcctcaggagaatgataagggacaatctgctcatgagagcctgggtcaccaggaacctttgcctgggtctaaacaggatttgccttcagaatgcctatgagataaaagagagaaatcaaggttaacattgagatttggggcttgggcaacttgaagggtgaagctgccatttaccgagactgggaagacccaggcaggagcagattgaaaggtggtggggaactagagttggttgggtttctgtcatatgtaatcaacagtcctcaccagcctgtgcaacatagtaagaccccatctctgaaaataaaaaatgagaaattagccgagcatggtggcgcacacttgcactctcagctactcgggaggctgaggcaggaggattccttgagccttgagttagaggttagtgagctatgatggcaccactgcactccagcctggggggaaaaaaatagagttctgactaaatatttgagtagccagggaagttttcacaaagtaaggaatatttgaggtagatcttagtgaacaagaattcgattctttctgttagggaattaagagtgtgtgggcgtagttaatgctcctttggaatctcatctactggtctatctggtctatctgtacccgtatattctacaggctgtctcactgagctttcactaggttatgctgcagtaacaaaagccccaaaatcttagcagctacacatacaaaggtttatttttcattggcatttccttttatggcagcttgactatgattctgctctatacaagctattttatttgttagatggtgaaaaccgtgacacttggagattgctgaatatggtattagtatgttcattcattcattcatttaacaaatatttattcaatatctgtttcatgccaggcgaggtcaagtactgagaatacagtggtgaataaaagaaacaaaatctctaatttccaggagcttatattgaaaatgagattgaacacatacaaaaaaaaataataacaataatgaatactatatttacaaataatagctgtaagagattttagtacctgttttaaattagaaaaatataaaaattattaaaactaaaatggccagatgtgatggctcacacctgtaatcccaacactttgggatgccaaggtgtgacaatcaactgagcccaagtgtttgaaactagtctgggcaccacaggaagaccctgtctacaaaaaataaaaaattagctgggcatggtggtgcatgccgtaatcccagcactttgggaggctgaagcaagcagactacttgagcccaagggtttgagaccaacctgggaaacatgttgaatccccatctctacagaaaatacaaaaattagccaggcatggtggcacacgcctatagtcgcagctactcaggaggctgaggcaggaggattgcttgagccaggaggtggaggtggcagtgagctgagattatgccaacacacttcagcctgggcaacagagtaagaccctgtctgaaaaaaaaaaatgcaaaaactaaaataaaattgctataaggttaatatagaaaagtgtgttcatattcttaggctaggcattgatttcttttttctttctttttttttttttttttttttttggtacaagacagagtcttgctctgtcaaccaggctggagtacagtagtgtaatctcggctcactgcaacctccgcctcctgggttcaagcaattctcctgcctcagcctcctgagtagctgggattacaggtgcccgccaccacatccagctaatttttgtatttttagtagagacggggtttcaccatgttggccaggctggtttcatactcctgacctcgtgatccacctgcctaggcctcccacagtgctgggattacaggcatgagccaccgcacctggccaggcattgatttcttaaacaggacacaataagcagtaaccataaaggaaaagattgataaagtatatttcattaaaattaagatactctggccgggtgcggtagctcatgcctataatcccaacactttgggaggccgaggcaggtgtcacttgagcccaggaattccgtatcgggctatgcaacatggcaaaaccccatgtctagtaaaaatacaaaaaacagctgagcatggtagtggtctcctgtaggtcccagctacttggggactgaggcaggagcatcacctgagccttgggaggtcgaggttgcactaagctgtgattgtaccactgcactccagcctgggcaacagagtgaaatcttgtctcaaaaagaaaaaaaattagagaatctccattcatgaaaaaacgtcattaaaagagtgaaaacacaagctgcagattgaaaaaagagaaatgcaatccatatatatcctagaaaggatgcatatccagaataaagtattacaaatcaacagaaaagcatatcaatgaaaactggataaaaagatttaggggcaggggtgcggagggaccgacggacgcacgggcgggcggccgggagccatggagcgcggccctggggcccgggggcgcgggccggggtgggcttcccacggcacgacatggagacctgtggttgcgaggctccctggggctcggcttggaccgcgatggggctgggccctggcctcctaacggggctgctgtctggggcggtagctgggggggcgctctcccccctgcccgcgactcggagcaccccacccctcccctgccgggccaggccgggcggcgttgttggcgggggccccggtggaggcccggcccgggcggcgcccgccatgaacgggctgtcgctgagtgagctctgctgcctcttctgctgccctccctgccccggccgcatcgctgccaagctcgccttcctgccgccggaggccacctactccctggtgcctgagcccgagctggggcctggtggggccggggccgcccccttggggaccctgagagcctcctcgggcgcacccgggcgctggaagctgcacctgacggagcgtgccgacttccagtacagccagcgcgagctggacaccatcgaggtcttccccaccaagagcgcccgcggcaaccgtgtctcctgcatgtatgttcgctgcgtgcctggtgccaggtacacggtcctcttctcgcacggcaatgccgtggacctgggccagatgagcagcttctacattggcctgggctcccgcctccactgcaacatcttcacctacgactcctccggctacggtgccagctcgggcaggccttccgagaggaacctctatgccgacatcgacgccacctggcaggccctgcgcaccaggtgagggcgaccctgggggcagctcagcctgggcacacccaagaggggaccaggcggggggccggggggcgggcttccctgggaggaaggtgggcggccctgcaggaggggagccacagtggatgcacagggccagagagccggacaggcgagcttgggtgtgcaggtgccgcctccacatggctgaggtgtggccaggcggtcctcccacaccctggcctgtggagccaggctccctgggaacccctggcctgaggatgggaaggggctgagcttgtcacaggggtgtggatgccacctggcgggagggagtgggtggtggtctgggggtctgtgcacgtgtggctgggagcccatcggctgaggcagcacttggggccaagtgaggcgaggctgctgcatccaggtccggaggactggcccatgaggccctgtggctgcggagcttggccatcctggggcagggcctacagggtaaggtgcagacccgcagcacacatccgaggtctgggccagcctcgattccagatccagccctcctagtcatccacgtccccagccctgtgcttgcctgggcccttcaccggtgtttgagcagcgcccgggccagtgctgctttggacgaggagacccggctgggcctctggtggcttttcctgctcgccatccactgggcctgtctcgtcctggccctgcccagcccactggtctgacctgctcccgcagggaccaggcacagctctgagaagtcagaggccctagggaggtggggtcgtcgttgccttggtgatatgcaggcagtccctgctgtgggcctgggagctggtcccctggcaccaccctggctccaggggcctcccggcagttgtgggacgctgacaccaatcaccacttcatgcggcttcctcggcccctcctgtctctactgcctgggccactggcagagtcacacctgccatggccagctctgagctctgtctgctcggccatctgtcctgctgcccctttgtcctgcaggaacctaggcccagagccatgagggggaggccagagcgtgcccagggcctccactggggatgtgtcccgttcgtttgagtggtgacatccaggtggcagctgggggctcctgcctgtagcaggtggcagggctgggctggctcagcacactactgaccatggctgccagggagcaggccggggaggccgaggcagagctggggccacaggcaccagccaggcagcatcctttggggcatgggtgagtggcgagctgtggagtgctgccaggaggctgggattccaggccagggacggggacagccctgctggtggagtccgaatgccaggcagaggggacgcacacctgcccatgctcctgccttgcaagagggcgtctgcctgggatcagagcctagagcgtgtgggaggagagttgtggggtcccggcatgggcagggtggcaggtgggtcccgcgtgcttgggactgggcacgaggaggccttgtaactggtgctggatcagctgggtcaggggccgcacaccaatgacctgggggtgagggtgcccctgggtgggagctggtggtgctgaggtggccgaggacttgtccactcccaagggaaggtgctggtgggagggggtgccacctccgcagccaccaccctcgatgctgacctgggttgcactggcatctcactgggcgtggggactccgagagtccaaaattgggtggagacatttggggacacagctgcctgaattcctcatggccaagggggtgggcaagggctgcagggaggaagagtgtccgctgtcctggccagtgcaccaggaacggctttctaacccgggcaggaaggtatgaagcattcaggatgtgggggccacacagttcccagtgtgcacctaggggtgaccaggaggaggagaggcgccagggcctcccttacccccgccccaggggcactccgtaggcaggatccctgcagatcctagctaggaaacgccagtgaacggcagcgcagggaacggggcggggccgctggcttcgcccaccgccacggtgttgggggctgggggtggccctcgggactggtgtggagcctgagcctgacccactgacttggctgagtggggagactggagggtcgcatccggagctgggcccggggacgcccgctggtgggaagggtgcgcgcgcgttggaggccgcggctgaccctgctccggcgccgccaggtacggcatcagcccggacagcatcatcctgtacgggcagagcatcggcacggtgcccaccatggacctggcctcgcgctacgagtgtgccgcggtggtgctgcactcgccgctcacctcgggcatgcgcgtcgccttccgcgacaccaagaagacctactgcttcgacgccttccctaacatcgagaaggtgtccaagatcacgtctcccgtgctcatcatccacggcagggaggacgaggtgatcgacttctcgcacgggctggcgctctacgagcgctgccccaaggcggtggagccgctgtgggtggagggcgccgggcacaacgacatcgagctctacagccagtacctggagcgcctgcgtcgcttcatctcccaggagctgcccagccagcgcgcctagcggcggccccaaccagccggacctcagcaataaggcggcccccggacctcaccccgcgccggcccccacccaggggctgcatgtggacccccccgggcggcccaggggaccccgccccgacccaggggctgtggacgatgtacaggcaacagagctacgcactcctttccttttggaagcaagaagaaaatacgtgaaaacggaaattaaagatttaaaattaaaaaaaaaaaaaagatttaacaggcacttcataaaagaggacatataaatggcaataaaagatactcaatctcaataccaggaaaatggaagttgaaaccgcattgatatattactgcacctctacgagaataacaaaataatttttaactgacaagcatcagcaaggatgtggggtaactggaatattccctgctaactgataaaacactttgggaaaatgttcagccatatgtaatactaaagttttatcattcatatagctctaaaaccaacaatgccacttctacatatataccccaatatagtaatgttctatttcttaatctgtggtggttcatttagtaaaaacacatgacctgtacttttttttttttttttgaggcagggttgcactctgccatccaggccagagtgcactggcacgatcactgctcactgcaatctcaacctcccaggctctgttgaccacacacagctaatttttgtatttttagtagagatggcattttgccacgttgcccaggctggtctggaactcctgggctcaagtgatccgcccaccttggcctcccgaaatgctggaattacaggtgtgatctaccacgcccagatcacctgcacgtttaaaattgtgaacttcttctgtatacttcagtaacttttcgaagatttctttgacacaaagttctcagaaatcttaaagctagcattttagaatagaaaaaaaaaagagcttttggttcactggtgaaattttactaattaaatttaaaaacaaaaagaaagctattaatgcataacagctcagaacaaagattaaaaaccaccagcacatcagttttccttaacttcgtgaagcactggtattcattctttcggcaaagaaaggatgaacaacactgtaactcaaagaaaagataccactgcaagaaaaggcttttttttttttttttagagggagtctcgctctgtcacccaggctggagtgcagtgacaagatatctccgctcactgcaacctccgcctcccaggttcaagcgagtctcctgcctcagcctcccgagtagctgggactacaggcacctgccaccatgcccggctaattttttgtattttcagtagagacggggtttcactgtgttagccaggatggtctcaatctcctgacctcatgatccgcccgcgtcggcctcttaaagtgcttcttttcgaaagcagctccaccagcaaaaggtaggaggaaagcgaggaaaccattcctcgcttggttaactcttgggtgaaaggacgccaaatgagatgatctaagaagcctcaaagaaagacagacaggcacagaaaaatcacagcaactctttggactgcaaacaccaacaccacagtccaacctaccagaaatcctgtggttaattggaggcttgccccgctagtcatgagatgattcagtgatcgctacaaacgctcctcacatgcatcctggacctggcacacctggcttgcccatcaccagcctggagacaccgccaggagcagaatcccggaggccaataaagaccccaactttgcaagtcaggggcgcgagcgctcttgcccctcaagttcccagaaagaacggcctcgagggtggggtgcgaagtcagtgtgctccacaggacttccgaagacgtgcccccgaagctgctccgtccctccaccccctgggatgccacagaacacctgccagggagtttcttccccagcgcccacgagaggagggctgcgggctgcagcggcaggcgaggaatcaagcgcagggaacttaggccccggcggagccctgcggagcccggcagtgcccggcgcaaccgccccgctcgcctaacaaaacttgcggcggcccagcccgccgcgcctcagcccagctgtgagcccgcaggtcccagactcacctcccgcccggcctggcgcggcgccctcacctccggaacgctgggtggacttcgcagtaaacttgaacttcccatccaggctgcagccgtgccgccgtacctcggccccgctcctggcgccgcaggtcgcccgtcccgcgttcccaaaatcaccaggctcactcagaagctcaggcagcctcgcgaccctcacctacccctcccagcaccgccgctatctccaccgccgcccagcaacttgcttgcggcccgctggctcctcagggtccggatgggccgtgtcaggagagcccaaggcacaggcgcagctgggccttaaagggacccggctgcctctaccgcacagcgggttcgggccgcgggccgagaaaaggagtaatggaggacagagcgcagcggggacgggaaaatccctctctcccctccgcctctctttcaaagcaccagcccttgaccctgcaattcgctgatttccccggccacttgaaccgcccctgccaggttaaagaggcgggagacacaccccctcggaagcccggagctacccagcgtttaggactgcaggcttcgcgctgccgcaccgccccatagtctgacttccgggctcggcccgcggcgcagacgcacaggagtcggaaggcagcccccagctcccgcgagaggtggccttaggtcactcgcaaaaacaataaccaacgtgtcaatggcacttgtatttattttctaatttaaatttataacagatttcgcagatgggcttccactgaaataagcctttgagaaaaagaaaaactttttttttaacaagattaggaaataccaagaaatatgaagtaaagccatgccatctacccagctaaaaactttgaaaacttgaaattttatctaaggcaaatgtttgcataattttaagtcgtgccattatttaaagtcaatttcaattaacaattgcattgcaactaaatacatcttctataagaaaactaagatacatccctgataatctacctttcccctcctatattccgtccatcagcaaatcctactggtttttaccttccaaattttccttgaatctgtcctcttctacctcctccatcaccaccctagtctaggctaccttcacctggggagtgggggtggagggactactgacctagtctccttgtggtttacccatatcccctttatcgcctctctaatctcaacacaacaggcagagtggctttttcaaaatgtaatgtgaccctgtcacttcccagcccaaaccacttaaacaccttcccgttctcttagacaaaacctcctaactaaccaagccctgaatggccaggcgctttgcccacctctccatgtcttcttacaggtcagaccaattccatcctgctctctctgcttcagccaaactggcctcttttattccctatttactcagcttcctggactccacagagcttttgctcatgctttgctctgtgcctgaagattcttccaaccctcatccttctgacgacagctgtagtctccacctctgagaggcaacttctgacctccctacggtggtcccttactcccatcacattgcataaaactgtaatcaagtggttatgttggggaatctaccatcagctccgtaagtccaggatttggttttgtttggctcatggttgtatttccacatttgtgaaatacatatttgttcctaaatgagaacgatagatgctagaagttgaagtaaatttggcataaagtcagagaaaggtaaaatgtcacaatctgatatttggaggcagaatctaaaaacttcagttatattaaaactgattttatatcgttttaggctggattgttgcagggactctttgggtaatctttaaaactgagttctcagagagccttgtataaacacctgaattaataatgatagccctgggatggtccacataaaacgaataacattggttgcttcaagagaggaagagcgagccaggcacagtggctcatgcctgtaatccaagcactttgggaggccaaggctgacagatcatttgagctcaggagtttgagactagcctgggcaacttggtgagaccctgtctctacacaaaatacaagcaaaattagctggtagtcccaaacacctgtagtcccagctgtgtgggaggctgaggtgggaggattgcttgagcccagaaggttgagaggctgcagtgagccatgatcatgccactgcacttcagcctggatgacagagcaagatcctgtcaaaaaaaaaaaaaaaagagagagagagaaagaaagactcttgactggtggctactggtgggaaagaggtttttactacatccccaattggacctttttattttaaagtatgtgaagataaataaatgacacaaaagagtgcataccatcccatttatttgaaattccagaaaaggcaaaattaatctgtggtgaaaaaatcataacagcagttccttctaacaggatattgactgggaaggcacacaagagaaatttctgggtgctaaaaatggtctgtcttgataggggtaggaattacaaaaaattcagttaacatttcaatgaatgtaaattttatcttaaaaactataaaaataatttaaaatttaaaatctagtagctaacacctagttgagcgctcagtgtctatgggtattggccaaagctatacatacacaattttgtttagtcctcatactgtcttcacgaggtaggtattattatcataacccccttgcatatgaagaagcccaaatttagtaaatactaaataactttccttaatttataccccctggaaaatgggggaagagctttgactaccgtcagtcaaatgccataagttattaaatattagaccctatagcacttctctgaaattgtaatatttttggtatatatatatataactcatctactagatcaagagcttcacaatgattgaaatcatagtttgctttttgtttgaggtttatgggtttattttatgttattattttaaagactgggtcttggctgggcacggtggctcacgcctgtaatcccagcactttgggaggccaaggtgggtggatcacttgaggttaggagttcgagaccagcctggccaacatggtgaaacaccatctctactaaaaatgcaaaattagctgagtgtggtggcgcatgcctgtaatcccagttacttgggaggctgaggcaggagaatcacttgaacccgggaggtggaggttgcagtgaggcaagcttgtgccactgaactccagcctgggccacagagtaagactccatttcagaaaaaaaaaaaaaaaaaaaaaaaaagactgagtctcactatgttgcccaggctgcacttggactgttgaattcaagccatcctcctgcctaggcgtcttgagtagctgggactacaggcacacactatcacgcccaatatttttgtcttaagtttctaaggagtcccaacactgcacagtagctgttcaatacattttgagtgaatgattaaaaacaagcttggtgttgattttattggtacaatttatatttacatatgtaatgtttatattatatgctttttatatatttatatgtgtgtatgtatataattggcaccaacgtagcattgctgtgcttaagtgcctgagatgtatctcaaatgaatagacctgaggagagaagcttgtgtcattagctctgaccctgcagcactaatcctggtttacccctttatttcactcaccctgagcacatcaattaatttggtgaaagagcttacactttaagtgtaagcttaacatctcactgaaatagttcattccaaagaaagagctaattctaacctctcacaagtgcttgagcatttgcataagtgaaatttcactgtgtgagtttcacccaacaccacctctgctccagctcctgctactctgctgctcatactgtggaactccacaggtggagtagaagatcatcagagagagttttatttgcagtaaatttggtgtgcaacaggccaagcaacgaggagtcaaggtgaggcagaagaacagcagagggaagtggaagttggataaagggtgaactgagtaggagcggaagcaggataaagaggtgggtgagcaagaagcaagataagcagaagttgagcagcgaaaacaaaagtgagatggagtagtgagtaaaagtttatggctggcaggatccagaacaaaccagtaaaaggcatgcatatgacagagaaaaagtagccttaaaatgaccccgtatgataatcagctcattaaagctaatgcatatggactgcatatcatgggtgtacttaaaattatgggatggaggtgatgcggaagcacacaggggccaagtaactaagcaacccacctatcaatcagaaggcacatgctgggtagagattaggcagccccaggaagaggagaaaaaagaaaaaaaaaaaaacatgtaaaaagacccaaagcccaaagttcaccaaactgacgctgatctcattttgcagaagtcagcccgttctcccctctctgagagtgttactgtgcttaataagtctcttgctgctttgctacatgtgtgtgtgtcacttccaattctttgttagacaccaagaacctgggacttcacaacaccagccggtaacaaaggtatgtaagcttgggagggaggaaagaaagaagggagcaagaggagattcagacatgagatgcattcaccctatgagttgaaccctggtctccagcgtgggagttgacaattctattactgaaccatcaatgctccgtttggtataacctctcatagtttttttttttttttttccttaaagataatctctagtgctatgggcaggcatgagggggcagggaggatggaggtgggaaagttctataataggctgacacagatatttttggaaaacagagctaacaaagcaacaggcacttgaagcaaaggcttgccgtaaaccttccacagtttgccaagagaagaaattctgtagtgaaattttcactttctctcttgtgtagatctctgtaagacacaaaagttggatgacagtcgttttgattcttggactttactagagactccaaagacgcatctgaggagaaaagctctgggtccctgggatgactgtgccactcgacatagcctcctggagtggccaaagagagtgtggataagaaaagaaatattggagtgaactttcactcactcccacttctgtaggtttcttaaaatatatgggtttagaagcaagatacttggcgttttcaaatgactcaaaagagatgtagatgaagagaagttcggtcatcccacagatcttccggagtaacctggacacatccctaaatctctagctcctgggtcttcgaaagcctgtttgcctcagggttgggaggaaagggtttggaaagtaccaaggcaagggttggcaaaaagattacctcatcagtgaggaaatgaaatttccagaagttttcgccagatctgggaccagagacaaatgctggatgaatttcctatgcaaacctcttttagaaccaccgcttcaaaggccgtccagagacttcaaattagatctggtgaaactgctcccggtaggggattggtagttcagcggtagaggtttttgtctcccacgccggcgactccggtacgactcccggccatgcaggacttcttacccttccggcaggaagggctactacgtttctacccaacgaagttattatattatacaggctgtactgcatttatggaccttggtcgtggcagctagaagctaacctgaggggcgtgccacctctggagcattctctgtgctcgaactaataatcccggaatttacgttcctgtgctcgaagcctgtccttgaaagtggggagtgtttccggtgggttgctgcagttttaaatactgggaattaaaacctttgctactttcatctagtctcccggcaaacccctgggtaacccaaagcccatcagagggattcgcgtgctgggctttccgctacgttaggccacgtctcactatggagcgaggatcaagaaggtccgggaaggagagaagctgcggggtccagggagactcttcggcggttggtcggagaggtttcagcggcccaaggaaaagggaagcgtgtgggaatctatccgcgtagagatgaggggcgcggcggagacagtcccacgcagaggtatgcccaaacaccgagttacttaacctcctcaaccaccttggcatccgcgccttccgtgggcccgtcggtcttccgggagagattctgtgtccctggtattgtgtgtcaacaggtgttagcctgatagttatatttttaatgagagaaaacgaactacagaatttgcgagttttgctttttttctggttttgctttatacctcttggattctccttccaaaggattccaatctgaggggcattgaggtgtgactatggtagacaaggggtggtgaattttcatccaaaaatctttggcggattcccttgctctcccgctccccagtctaagagcagtttaaaacagaagatcagaaacatttggagagtgtttttttctctgcgttctaatgataaacttgatttattcaattccaaaagtttccttattctgaggttgtctttccatattttgagtataaaaccatggccatactatatgttggacccacgaaggttcttctcttcacttgtttatttgtaaagtctctttgtaatctgagaatttcttgagtaaactgggaactgttacacataattctgtgtttttgagcattctttgtaaacaggaatcaggattgggggtggggagggagggaggagtgggagtcctgatttgtgtaacggaaaatcatggattacttatgtgatggagcaaagggtttaaaaactcttagcgtccccggatttccccttttactgtttgctgaagaaaattctgtccttgactcccttccttaccctctcctggcctgtgagaagcttccgccctattcaagttatttcctcctcccctccccgccaccctcccccacccccgcagcccccttctgtttttcagtgaagccgctggaggaaagtcgggtttgtgagaagacccacacaggcaaggacagcaggagaacagtgacatagttacactcttgtcaccagcactgtcattaagaagttgtaaaaagacaaagacaacagaggagagcggagaataaaatctccgtttcagctattccaggatgttgtgccaattgtcccgtgtccttgataggaagtagtaaggagctagggacatttttcctgaaggcttccattgctggcaaaatctcattaaaggtgtctacattgataggttggccacaggatggatacaagaacaggctctggcttacctctgccaagatatatgtgtaagaatactctctgcaacattaatttttattgtaaaatagcagaataattttattattcaatcattatataatgttcaaatgtatgtgactttatttggacaatgaaaaatgcagttgttaaaaatagacaatacagatgattcagatgatgttactgatgaaaataacagatgtcaattactgagcatttatggcactcttacatacattaacttatttaaagttcagaacaaccaaggaaatgagcaacctgtggcgggcgtgagaggttctgtggcacaaaaggaagataggcattcaaagaacaccaggatagaagagccgcagtaggccgggcgcggaggctcacgcctgtaatcccagcactttgggaggccgaggcgggcggatcaagaggccaggagatcgagaccatcctggctaacagggtgaaaccccgtctcaactaaaaatacaaaaaattagccgggcgtggtggcacgcgcctgtagtcccagctattcgggaggctgaggcaggagaatcgcttcaacccgggaggcggaggttgcagtaagccgagatcgcgccactgcactccagcctgggcgacagagcgagattcggtccccaaagagaagaagaagacccgcagtaggaggaagagagaggaagtggagtcggccagctgggatgctggaagccactggatagctcaggctgagagagggcgctgtgctccgcaagcctccctgcaaccgcaggcctcgggccgccttcctccaggaagacgctccagacttctggtatccgttgagatctagtttcccttgagacgctgcaaagcgcatcgtccttgagcatttctcctctccccaagaccctccgaaggaaggatgagcggacggaagattcacaccgaagtggtcgagcgcccagatccccggcttccccgggagcatttcccaagtttctttcatgggtaagagtgggcccggcaggataatgcctccggttctatgaggagcagtgggggagatgcccacgtggccacctctgtgggctacacgacccaggccttccaggaggagcgaggagtcctgggcccgggtcagcggtgccaaaagaagcagcaaggcaaggggtcccctcctacctcaggatctctgtcctactggggttaggagacgttcatccaactccctctccaagtgttggagaggaggctaggtctttcccacgagctggggaggaagaggtggcagaggcggaagaggaagccggctgagatgtgtgaagcagctctggctataaccggtagggagagggcgcgcgggacccaggagcctccgtgcggagccaggcctcaggagcagccgccttgctcctggaaggggtgcctccctccatcttctgtccaaagactgtagggagaccttctcgcctggtgggaaagcgacgtctcccatgctttcccaccacgcaggccttgtgtcccttttcctgctagtgtctgaccgccagcctgcgggggctgcggctgccgcggttctacgctgggtggaggctgcccgcccgctagccaagagccgcgctaggaggcaagagtcgggaagtcgtgtgcaggccgggaggagtcccaagctctgggtcagggctttttttgccaatagccaaattcaacgtgtaaaagacagagagctcacatctgtctgttcgtgagcttcagtcggaacaacaaggaaggccctcaagatccctaggagggtggcggaagggtctctagcggcgatatccgcgtcgggggcggtgagccaaggactgtcaggagcctgcgtgaacccagcccccgggtagcgcaaacaccaccgcagacaagcgccccgcgtgtagggaaatcgcaggggtcagagcagctggagtgtggtggactagcctcaaccagggagagctcccttcttgaccacggtctgtccctcgccaggtaagaggagacgagtgtcagtacagcctcctctcccctagccagacgctcagggtcaccaccttcccctctgctcgcccgtcgccattcttccaaccactcgctgccaaagattccaccaacagtcacccacaggacaacccaggcctcctttcagcagaggctcccgccccgcagccaccgcgccctctcacccccgcagttctgcccgccgcctctgcccagtctgtgcacttcacctccctcgctcccgctctcccctgagctttacagtggacacagggttcgtcccaacccttcttgggagtactgaatggaaaagggggagggtgcacaattgcttggtagagtgtagacagacattgcgggatttgactgtggtactatccctttgatgtcctagtgatttttacacctgccttctgcttagggcaccggccacagttttccattagtgcctactccacctgctgtcgttgttgggtaagcgaacatcgccctcctgtaccacccagtcaataaatgggcggtcctggaggacctcacccgccgctcacccccctcccaacctcgcggccatcgcctcctgtcgcctcttccgaaggcctaagaagcatgttagctgcgaactgaggtgaggaggctcagctgaccgcctgtgtcagctgacgacgtgtgccgcacacaaacgccacgacttggcttggcctctctctctcttagttatttgcagctcagcccaatcggcgcctctgggatggcggaggcggcaaagatggtgggcttcttgggtacacctccaggagagctgccatctctgcacggtggtgtacacctgagcgagacgctcagtcgctctctaaagccccttctgcgaatggtggacacggagataaataagagggtgtgtcatgagaggccgtccaccaggacttgccctccttcgccagggtttgcaccttgcagggagactcttctgcctctggctcttggagcaggccggctgacagcggagtaaagaaagattactgcgggtgggcagtcagtgcaaaacaactccctgaccggtaatcgaacccgggatgcggtggtgaaaggactgaatcacagccactacaccagcacgggggcacgggagagtctttctcaaccttattgccatttaagtgactgtttctgagtgcgctgggaggacttgggccttgtgggggtcgctggtcgctcctggagtcgtctcacaaggcctttccctccctcctttctccaaaagaggagcccgcaggcgacacacccagcactctgcgaggcccaccaaggccctgattcccgagtcctggagcgagttgcagcgccctggctgcagctgaccactgacctagagatgtgcctttgcgaagtggcagcgcatggagaaacagtagcgggtcgctggggccagagccgcccaccgggtagccaggagcaggccggagcgaggaggctcccggggtgagaccggggcaccctgaacatcataaaggactcagaccttggcattcccgacgtcataaaggactcacacggatgcggaaaccgagacgggctggatggaaaactctttccagacagactccggggccctcaactggtctccgaccttcccctgcaacctgcgacacctgccattttcccatcttaggctccagaagcagaatcaagtgggatgtcttggaagaaaaacaaacaaaaggcccactaggtggagtgaaatggatcaggagcaattatgttcaatttcacctttaagttttctcaaaaggaggagcattaagaatcagccaccttagtacatacttaaaggtaaatattacatttaagaaaatccttgttatcttaatgtggcactgagaaaatactatcaagtacagcacgtggactaagttagaacattaaatacacaggatctcttgatagaattatcctcagactttccagttttaatcttctagatttactgaaacctgatcctgtccccgctgatgaaacatcagaggaatgggatcctgtaggtgaagatcatcagcttataaaatcctgttgccatcaatgggggtagcaggaaaatgatgaagattggttaaggggccagtggactcagcattgaaatgaatcatggacttgaagccaaaagactcagtttgtgtcccagctctctcaagcaaagcccccaagtcccagtttcctcatctataaaaaataataaaaatacttaatggacaaagttgtgtgggaatcaaatgagataaagtatgcgctgcatatgccctaaagtcttatttaaataaaggcattcttttcatctgagaaattgaagaaaaagatgccctgaacaagaaagacaggagaaaagatttttttttttttaatgaaggataaaatgatgaaatccccccaggtattgctacagaaaggccttacccatgagctgtaggcatatatccggtcctaaggtccattttggagtagcccagcactcagtctgaaagattggacactgagaaatatgtgcatcccatttttctaactagcagcattttgatcctgtcttattatccatacccaggctagcacacatgattttttctgcttgcacttcaggagaagatagtcattggacaaaaggtgggtcattctcacgttgaccaagtttctgttccagtatcaccctcccaggtaggcctttattcactctaaatagatcacactgtctaaaatagctacctttcctgcacacagtctcttactatgccatttactgtcaaagctcttctcactccctgatatgattttgcatgttgatttgcttgttcattgcatgttccctcactacaatgtaaatgtcttgccagttttgatcactaccatatccctaaggcctaagaatgttcagtacatactaggtgctcaataagtacctttttttttataagtgaatgaatgaattctatttttgtcttattccattgacattttcctgtcttagctgccttggacagctctgaaagttcttctgctattttgtacactattgtctttctctgtcatttgaatcttttccttacttagtttgggttcctccaatagtagagcttgagacaaaggtttggataccagtagtgtatttagaaggtgatccgaggattggagagaacagggagagtaagaagagaaacaaagaagaaccaacaaaaaagtgccttacctgggttgctgatgtgggcagcaggcactcaatttcatctgggtttcctgagagatgtgcagaatacctcccaaaatacagaagatggaacattaattcacacaaactgaaaagtttgaaaaaaaaattagtctttgcccttgagaaaactttactctgagtgaaaatgaaaacaagaaatgcttgtgacttattcattgtatcaaagggaattaaattttattgagtaccaaacatgagccagggactgtacctggcaaattatatatattgtcttatttcattatggcaacaggagctgccatgcatcaggcagctacaatttaaccaggttcttcacatgcatgctctcaccagttcttacaactagtcaatatgagtttttatttccatttaagagatgagaaaagttgagacttggggaaaagaaatagcttggcctaggtaacaccatcaattcatagcagatctttctgactctatagcttgtcctatagagaaacaattacatgtaaggaaaataaaaggcaatataaatttaagtgagtgactacatgacactttcttgtgaagagttataagaattcagagaacgcaatgtgcaacatgaggaccatggtcaataatattatattgcacactggaaatttgctaagatagtagattttaggtacttgtactgtaaaaaaagaaaggtaactatgtgagatggtgaatatgttaacttgcttgactgtagtaatcatttcactatacatacgtatatcaaaacatcatgttgtatactttaaatttatatgatataataatataaaaaaatagaattcagagaagtgaatgactgttgtgagctacatttaaatttaacaagattttattaagaaaattaggttttttaaaatttttaagagaaaagtggggaggagaaaatggattcctctaggccaaggaaacagctggagagaaaggcatgaagatgaggtaactggcttcatggaacctgaattatttttcatcaaagagctcaaccccccatattatctttcataaataagtagtgtgccatggaattatggaacatgaaaggtatggatttagaacatgatctaggttaaagaaaaaagaggaagaaaactaaaagaaagaagaaaatccagattgttgggatgattctgaggccctagaaccttagaaactctaaactctttcaaagtgtatttgaagagacatatattcagtgtgtgcagtctgacaacagtggaatgccaataacatttaatttcctggacttctaaacttcttaacctgttgtgctgctggaatgggactgtaaatcaaaatatgctaaattgtatggggaacatgtgtatttagtcattccaaactgcccagtgattttttaaaacactcctcacaatagtatttatgctggtcttgtttttcataagtctttcttctcaaccatgctgcaactggttaatataggcatcaaacacagcacacaagaaggaagaatgcagaaaagaaattcagaaatggatgagaaaggccaaagtatccctgacatctctcccatcccaactgttctaaatgttcttccattttcaaacactacaacaacaacaaaaaattggaatattgctttgggtctagtaaatcattagcaaattaagaacctgtttttaataacatttaacttgtaaataatgcattaattgactagcctgaatgttagtttgagcatttgaaactctgctactaaatttgtaatgaaagaaatgtgctgcaacagtaggctatatggtgaatataacagattaaatatgacagttgatatttgtgaaaatggggttataattagaggacacctgcagctcttttccaaccaaaacaacagaaattaaacttgcataaattgtgtgtgtgtgtgtgtattgcattttctattggcatgtttcttttgttatccttgagtcttgtgttaggttttatcccccgtttttcaggtcatatgttaagcaagcaacaagtggccttttgctggacacactttattggatctcaaaatgacacatttttgggaggaaaagaaaaaaaggacacagagatcttttttcctaggagttaggagttactaaaattcatgagtgatagcccagcatattataactgctcagaattagaggaagccatgtgaaaaggaaccagtagggatttcagtctcaactgccttgcctccaactatcaagtaggatttctcagacgaaaacatgaagaatgtggcaccctgccagctatacattattaaaattatgcatggcagtgagtcaggtagagaagttgctagacatagggattaaaccaaagagaaactaaatatttgcaatgactaataattaacaaagtgctgtcatttcgctaattcattgtttctcattcattcaacaaatatagataagcaccttgcagaggctatactaaactaggccctgggatacacagctgaataagacacaaatcctatgccctcaaaaggctgaaaatctggtttgggaaaatatctgtaaatcaaaagaaaggcagatcatgcaagtcagagaaagagatgaaatactaagaaggaaatcttggcacatctgtcaaatgcaacagggaagttaagaaagataaagacagaagcatttctgttgaatttgtcaatcaaagttcattagtgaccttggcagaaactattttagtggagtgttgggaacagaaaccagattacagtgagctacaggatgaataagaaagagaatgtagaaaagtgagtgtagactgctcttttcagaagtctgactatgagagactagagacagagaaagagagtgaggaagttgggggtggtgggggagagaaagtatgtaaagagttggttttcaaaggcctgagcaagttgcgtatgctgagtagtggtcacagccgttgcacacagagaatcttggcatattaacatacatgagtgcacatcagttatacattttttccctatcagaagttgaaattcccttttaatattccaagtattaaattctcatttaatatgctaattagcctgcattttacaacagattgtattagagcctggatacacatccaactcgattccatgtatggagccgtagttgatttggtcaataacttgcattgttctgcatgagaacttccacaatttgctacctcattctaatagggtttgcttgaattatatgaaatcaccacctttattggtcaaaaccagctgaatattggcaatttcatgtggttcaacctaatagtctgcaggggtctggggagatcatagcatgtgaatataatgttgaatgagacataggaagaaagaaacaagatagctgggacaaagggtattgaatgagtagaaaaaaagtagtaatctttttgtttgggttaggtgtgtgttcccaagggaaataatttttgagcatgtagcttgaaagtaataataccacttttaggtagtacaaatggctcaggggatcaattgggatttagggagcggggcttttacctgcaatctgtccaatttagtcagactaacttgcaatttttacactgttaaacatcttataaatctgagaccaacagatcaaagaaaagctctttcaattgagtgtctgggtaacttgtggcaaattttttatccccgttgtaatgtgattcctccatctctaaagtgaaggcatggattacccactcattctcaatccaatgtgaaaggtccagaattctgtgtcagagttaagagagtcctggtgcagtcagcaagggaaagtaatttttccaaactgcctgtgctaaaaataaacccagggtagtctcaggggagagctacccagtccctttcacggacagtaaattcactgtggtgggaggtgaagatggactgaaaacaaatacctgaagaaagaaaaacatcctaatgcaggcaccagtggtgagttgatgggaactgagctaccactgggaatgcatcacctgagcattttctccagagcagagttgttggacaaatctatgaggagaaattcccacagcagggcacaatctgggctctggctaagttcttggaatgtcatttgtcagctgtcagaatcctatattcataaagggagaggaaaagtctcactaaaatgcaactaaagaacacacagcagcagaacctggtctcttctgtgttaacagaacaaacatgaaaatagttaagccaacatacttggaatttgtgtcaatcatgatactttcattgctcgtcttgagttctcatgtctatcatgccacggtgaggcaatcactcagaacaacccatggcattttgcagagcaccaaagaagaagaagtggtgaatcatggtcctgagacttggttacacagtgtcttagagaaatatcccagctccttctcaagctacaaaattcctcctgctaggccaagaatagatatggaatttcctatcatctctgaattttttattactgagttgcaagcagagctctttctcctattgtatttatattatcataaaattgatcttgagtatgtagaacttaagaaagtctccaaagacagatctggatgggcctctgtcttccagcttataagatgtattttgtaaaatttagcatagctgcttttattattataatacctaaaatgtatgtgattaaatacatgaactgcctccctgaaggtaagacagcttctaaattctaaagctaaataatctagcccacagggccagacataaaattgcacccagaaattcataccaaatgtcaagtcactttggggttactcctgagggctcaatgctgatcatggttaggaagaggtaatttgccccactgtcttgcttgaggatgattttttactgccacacatggaaaaagttgcagctaattatatgattgttccaaattatgagttctcctccctaaaagaagcttataatttcccatcccattgacatcaagcttggtcatgtgacttgctttggccattgaaatgtgagcaaaagtgacaattaccacttcccagtggaaactgagagccatcttgtggctccacaattgctcttctccctctgcccaaagaatggcatgacctaaatagggactcaatttcagaatgaagatatgtagagctgcaactgacctacagccaacctgtaacaagagagagaaataaatccagatggttgtaagccactgagaaatggtgattgtttgttaccagagtataacatagaaaaagctatccaatacaacagtaaaacaaacccatcaggtacaggaagtggatctgctccctgaaacccataaacgaccactctagctgtatcttagcacaaataaggaagaggaccagaaaagaaaggaagaaaggagttagggaaagaaatctcaatatttcccaaggaaatattggtggtgttctagaagaagtggctatgttacaacagttgcatcttaggacatttattcacttccaggctttcatctcctctcagtgctgcaaggaatatcctgctctaagaacaccagtttgaaaaggactggccatagatgactttggaagaccaaagagttctgtattgacctcagttacgtccttaatactctccagcaaacatacaatatttccgtagtccattaactttcctactcccctgaaaactgtttcatgcctactcctcccttctcaaacctctaaatgcccctgtcatcctcactccaagctgattattttgcttcctagttcactgagaaaataacagcaatcaaaagaaactgcactcagcctccagcaccacctccttttctcctgcatgtgtgcccatctgctcaacttttcctcctagccatgcttctagtcaaaatcaaccccttagcttgctgctagatcttattttactcatctattgaaggacgctgttccagtgattttcttttatttcttctactttgcctgttttttctctatttgatcactctcaccaacattcaaacatcttgttttctcatattttttaaaagactctctttactccaattcctactagcgattcccctttctcacacttccttaatagcaacactctttgaaagagtgtccatatcccctgtctccaatttctttccttttgttctctctagacctcactctaatcagactttcacctgcacctctctacagacactgctctgatcaaggtaccaaaactcctactttgctaagccagtggtcatttctcagtcctcattttatgcaaacaatcagtagcattggacacaatcactctctcctctttgaaacactttttttcctccactgagcttccagactctctgcttgttcagttttattactacttgtctagtcacttctttttgtttccctcgatgcttcttctcatctctgcagttttactccccaggctcagtccttgaacctttttttttttttaatctatgtttactccattgggaagctcatccaatctcagagctgtaataaattggtacttccagcctggctctctcccctgaaactcacactcatgtctttataagacatgatacatgcatggaatggatacctaacaggcatctaatagttgacatgtctaaactaaactcctaatagcctacagcagcatcacaaaaactgcatctcccacagtcttccccatctcagcaagtagcaactcttagttcaagtcaaaactccttgcagtttccttgagtcctcttttttcatacccccattctaaacatacaaaaaatcctattggttttacattcacaacacatcaagaatcccatcacttctcattgcttctactgctgccgttatagtctgagccaccatcatcttttgcctggattagtgcagtagcctcctaactgttctcctctttccgtctttgaccttttctagtctattctctacactgttttaatgaagcaataaagttatttcattaaaacatgccaaatggcactctctcctcaacatctccccagagtcttctctcatgcctcctggtaccctgctcctcatttattccatccactccagctatactggtttccttgttattttttgagaatataagacatgcttcgatgtcagcacctttacatttgctgtttcctctccctgaaaatgctttcattctctccatgaactggaagcaaagtcattatggctcacatcttccttcagatctttactagtgaagtcttccaagactagcctacttgatgttgcaaaccccacccagcatgctctacccaccttccttactttatcttccgctaagcacttatgattgtctaacatatcatatgtttgacttacttagattatttattgtctgtatcccccaacctggaatgtaagctccatgagggaagggagtttttattaactgctgtacccctaaatacctagaataaggcctggcacataggagtctcaacaaagacttgttgaaagaataaatgaaatgtttttgcaaatcaccttcttaatgcctggaaatgttgatttagtgtttcatcccctttacttggaataataaaagaatattaaggttgcaatggctttagagttaatctagtttaatactgtcatatgacacagaagaaaactttggcctagaggaggaaataagctttctgaggttgcatacctagctcctatctaatggcacagcagggccagatgccctggctcccagcccatctctcctcccacagtatcaaccaccccatcctccttctggcttccatgagtaaaactagctcctgctaatgcctctgcttttattttgtatctcatctttgttatatcatcttgatatcttcataaatctgcttttatctcattttgcaagaatatttgtataaaaataaaaagggatgatttccacagaatttaaacaaaacccctacagactctactaaaggtttcattagattctttaaagatgcattatgtataaatatgcaaaagatgtgttagaatttaaactccaggaaaaaaaaaatgtttcagaaaacatgattaacatgttaataatggcacctaactctccaaaaagtgtggcaaagattcagtgagaaaacatacattgcctgccatacatgaaacatggaggaagcgtatgctatggcacaggttggtgtgtgtggggtgtgagacttctgtgagtactagagttcctacatatccctgttgatgttacacaatattgagacccaattttctatcttaataaaaacatatgtggtgaatttgtaatggtccaatttgtcacggcaatttattattctacttcctagagcactttagagaatactttttaaatactgatttaaaaaaaaataaaaagaggcacaacatctccctgaaccagtaggtgccaacagttatcatcatctccgttttgcctatgatataaattaaagcctaaaggttatttacctcagttcaagtgcagccaagcaatgggagatatggaaccagaagctcgaatgtgtaattcctaaacctgaattagttcattgagtcagtcagccttgtaagcactagtaggcaattcaagatgaaaaactaaacattatttttctttcatactaaaaatttttcactgttcccacagagaaatagggtctacatcccatggccttgaatctgggtggtctctgtggctgtttggccagtaaagccatagcaaaagtgaagccagcccagattccaagtctacaccttatgaaactggtagctttcactttctgtctcttggaacactctctctggaaacacttagtcactatgtaagaagttctactaccctaaagccaccctactagagaggccatgtgtagacactccagacaacaagcccagctgaaccccactttctagccagtggcagtcatgtgaggaaagccatcctgaccctcctgacaagccgacccaccagctgaaaaccattgagtgtcctcagtcaatttgaaatggagcggaagaatcacccagcagaggcatgcccaaatgcccaagcaacaaggtcctgatataataaaatgattgttatttttagccactaagttttggagtaatttgctatgctgcagtagataataagaacagaatttgatacctggaagtggagtgctgccataactatctaaaacatgtggccatggttttggaaccagacaatgagcaaacgctgcaaagatcttgaggacactgttaatgagaatagaaaaacctgaaggagacttctagtgaatacttagaggaagatactacaggaattactattggaggctggagaaaaagtgaccctggttatgaagtggcagaaattttgacaatactgttgcctgttgtgatctagacaatagaatatatacctaatgaactgatggatttggctgggtttggatctctgataggaatgccagaagtgccaaatgatttgttttatgcatgtataatactgtatagaaaaaggtgagcttagaaatgaaatgtttattgtagttaaataattagttatattattttgtcatattactatgtaattcctaggaagcaggactgagatgtaataaaagaatgtggacatgtgaccagtaagatttcagaaatactacagactagggactgctctttgcttttcattctatttttgaatgagaatgccaactgcatttttcttaccttcatctcgacattgtgttttggggatggaggagcaaataatgtgtttctttagtccacaggtcgagaggaaccatacttgaagaaacatacctgaagggtttcatccatatgtgggcctgatttggatgataaaatcctgcatcttgagcctgatcttgatgctgcctgtgttctgatgccatcaggagttgagagtctaggggttttagaaagggtgaatgtattttcccataggcaaggaacataatcaatggccaaaatgtgcactgtgacagattaaaggttgctacaaattctctgatacccttccattaagaggtagggcagatattccctcccctcaaatctgggtgggctccatgacttgctttgatcaacagaaaacggcagcagtgatgctgggccagttgttggatccaggccttaagaaccaacaacttccacttaagttctcttggaacactgagtccctgactaccctaatatcatgttggaaaggctacatgtaggcactctagttgccagtcccagccaagaccagcttttcagccatccccatcactaaatttgtaaatgaagccatctggaatctccagaccagctcatttggcagctgggtatcatcaagttatctctgctgactccacatggaacaaaggaatcacccagctgagccctattcaaactattgaccaaaaaaatagtgagacataataaaatgatgttttaagccagtaagttttaggataatctgttacatagcaagagataaccaggacactaactatacatgcatagagtaaacagaggtaggcctactttccacattgaattgtgctttctaaagaggtgatgatgaattacctttttgtaaaggtaatacatttcaaatgtgctaaggatgctttctctttttcttatccataaaacatgcagacaatagtcactctctccttagttcataagaattttgagaggaacaaaggagataatatatgtcaaaggcatctgcaaagcatttctcactaagcaaatgtaagacattattacttttatagaaatttaagtaaaatacagggttttgtgcaatttaaataatcacctagtttctatcaactttggaagtttagctaatcacatatctgattcttctacatactcaggtattcatacacaggtataaaattgctgtccaataaacatagactttcttcagtactaaattaaagcagtgcttgttaataaaaaaatcagtaatacattttagcacaatgttgacatgtaacacatatattttaactcaaatatgtaaagcacaactggtattagttaattcaatcaagcatgcaactcttgaaggaggtgggaggatgcagaaaacagctagcttgaaatggaaaccacccctgtgctgtcgttctgcctcatcttggttcatgatgttctcatctttatgcacactgtgcataaaggagagagataaaggggtgttaaaatactttattctgtagcacagaataaagtgttatgaaagtacagaagtagacacgtgcattgtttcttgttaggaaacctgagactgtggaaaacttgctgaacttcaggttactgaactcaaatataatgtgatgttttatgcttttaatgatagttcttccctctcagaaacttagcatgtatagtctttgaaaggtcttttcctatatttactatcaaaaagaaagctaaaagcatataaacacatgagcacacgtgcatacaaaaaattatcccttggtagcactggcagtgtctgctcttaactctaacctttcatttaaatggacagtacacagtgaattgtccagtatctcggctatcatgtcacgcagtcatctctgcatcagctccccctatcaatgcctctttggagtcgggctccaatctgcagagcagatagaattccgaaaatcctgagcccctgtcgctgtgagcttgtttgccaagcacatcacaagatgagtggtgagatgctgttcacatattggcccattatcccttcaatatatggagcttcaaggattttcagggccatataactgaagagagtttaccacctaccagaagaaggaccaaactctgactggagaaatcttgaaggtgtaattaacgtttgtttccatcccccttcagccaacacctttactgcactcacacctgagattcagggaaagtgctaaaaaacaaaaacttttagtagaagcttcgaaaacatgggcaagacaagacccagaattcattcttatttagcatgttggactgactaagtacataaaaagcagcagaagtattgagagcttaccaggtatcctcaaaacaaccctaaaactagattatcctcctcatcctacaaatgaggaaaccaaggaatagggaaattgaggagcccactcaaggtcacatgtctgtcatttattgaaaggaaagaaacatccagctccttggacttcaaacctgagccatgtgcctggccactgaattatactgggttctgggtgaggatgagggcaataatgacagctgtcatttattgaaagacagcataagagaggagaatctgagaaatttaagataggcagagctccagtctcaatttccaaatacctccatgaccccaggcaggttactgaacatagctgagtgtcaagttttcattttaagatgggaataattacaacactcacttgtggggttggtgtgagttttaataatctgtcaagtggctggcatttaataagcacaagagattaattattagtagttactatgtgccaggcaccattcatgtattcatgtttcatttaacctaacaataaccataaaaggaaaatattatacctattttacagatatgtaaactgaggcctaggattgcctagaatcacatagttaagtcaggatttgatcccaggcctatgattccaaaaccggtgttagttacacaccgttatttggcctctctcaatacacgagcttatgtcaacctgtgccacaaatgactttttcaataatcagttaacatgtgtcagctactaatgtggtgaggctgtattgttgagttaacctattgcttttcaaattctattttatgctctaatgctcaggagaaaaagacatttaacttatatgtaacttatctctcttgggaaaattattgaatttataaatggtagcactttaagaaaatatcaaagatagcttaatttcgagaaaatgagtctggactaagaatcaggacacttggcttttgttttcctttgcttttcacaattctccactgactagctatgtgcacttagacatgtcccttaacctacaaatacctctacttcgtttccatgaagagagacatgagcttgaagggtatcttctgattctaagttgttactatttagtgcctgcgacacatatgcacatatgcacacgcagaattcaagagcctctagagcagtagtttttctcactatccaacaacatcgttgttgcttaaagagctgtttcaaagctcagattttgggaaccttcagaatctgacttggttaatcaggttgaagctggaggatctatattttgtgaacacttcccagcttcttcaggagagaagttaggcctggtaatcactgcttcagaccactttgcgggtttggcaaaataaccatgccctgaaaccacgaggatgaccgaagcctgcctcacgacctctgttccatggagtaagttcattgataaggcagagctgtaacgcaccaagtttgcatttcttggccatatattattacacggtgtgtaggtggaaaaaaaaatttacagattattttcctgtagaaaagggaatgctgccaggggcggtggctcaggcctgtaatcccagcactttgggaggccgaggcgggaggatcacgaggtcaggagatcgagaccatcttggctaacacggtgaaaccccgtctctactaaaaatacaaaaaattagccgggcgtggtggcgggcacctgtagtcccagctactcgggaggctgaggcaggagaatggcgtgaacccaggaggcggatcttgcagtgagcagagatcgcgccactgcactccagcctgggcgacagagcaagactccgtctcaaaaaaaaaaaaaaaaagaaggaaagaaaagaaaagggaatgctgtcctgatggcatcaattttaaaactggagtaaaactctagaaagcagtagaattaacctacttattagtggcatccctagtatggataattacattcaacttgagaatcacccaaagtcgagaaaaagcatgatcaataaggcccaaatacatgatcagtacatgaacaccaaacttgtattctagtagatagatttagtgagctgggatcatgacatgatacctaaacaggtaataaaattgaacatgaggggcaaaatgtattgaagagagtccaaagacaaaaacagtaatatatctatatgaagaaatgagttatagctatttaccactgtcaaacccacctgaagtcagtgtagaagggatgccaccagtcagaaaggaatgggtcatattttaaagcattaaagcatgaatatcacccagaccatcatagtaaacatgtatgtatcaaaggaccaatgataccatgtgtaaagggctgaaggttatgtaggcacagtccagtgtcaacatttctaaaacttaaggattatgcaagccagcaagtaaatgcacaaaaatcatttgccaatttaaagagaaattctgtgtgtgaacctcagtaattatttttcaagtgctattttcaaaatggagctaacaactctgtctacagaatgtttgacaattattaaattataatctacaaccacactcaactccttggcagaaaaagacatgtgaggaaaggggtgaaatggatgagagcaatatagtccttaaaaacacctggacaccctcccatataagcttcagaaatcacaaggatcaggcattcttcgagatctaatctcaaaacttcatcaggtgtttattatgtactgttaagaaaaaagcttaatgacaaactgaatcctacatagatgactagctgcctgattgctctgcccagagggtcataggaaacatagggatcaaagggtgtatccatgttcatggaagctgaactccagtttcactgtcttctgcttcccttaggtacattttattaagtcttctgggctgaatttggaaatccttgatgttggaagaaaagctgacctatttccttatgctggagcttttctgagctgatgttcctccaaaattacatttttagactaaaagataactaaccagcatcttgatttcaatcaggaaacaataaaatatgatgctatttgggttattttcttatcttattatttgttggctgggtattcacttaaaccagcctgccctatatgttaaatatcaacctaagtctaaaatattttaccagatgtcttcttagtaaaactcaataaaagtgaacagaaggaaaatccagagcacaggaccagccaaataacccaaatagactcaacctaagtcctcttcttagactcattatcacattacagtatctcttcaccaacaccaaaccccttctgaggtgacagagggaggcaagaaaagtttgtgttttgtgttatatttatttcctttgaagtcataagccacatatcatctccttttcaaaatcaaatactcctgacttcctccatcattcctttctctaatgttcagagggctcttcgtctatccccatcttccgtaaccccagataaacttaagcttgttcactgtctcaactgtcgctcataaaatatataatagagtagaaagagtactgtttgggcaggagatctgagttctaggtctaatcctgccacttgctagttttgggacctacaacaagtcttaaactattcaaggcttcagtggctttattactgtaataatgcatttggaagggttgctattgaggatctaaaattttctagctacattttctataattgtagcactattggctagctcctgaaattaagcaaagatctcagggttgtcctatggcaaatacctgaaaatgaaattattttttatgagcacagataatttttaaaaaagctgatatatgctaattttattatttaacaaagtaagaagtcaagagattgtttcattcttggcacgattcgagaaatgtgggattatgtatgttaattaaaattttatgtaaatacaaacactccaatcatcataagaggaaaaagaacaaagaaagcctagttcatatatcaaaagaaagaaaaaaggcagccacaaagaagcagagacagagagacagagaaagcataaaaaaagattaaaaaggatgatatgagttaaaaagcttctgcacagcaaaggatacaatcaacacagtgaagagacaactcatagaatgggagtaaatatttgcaaactacctcctctaacaagggattaatcaccagaatatataaggatctcaaacaactccataggaaaaaatccgataatccaatcaaaaatgggcaaaagattttaatagacatttctcaaaagaagacatacaaataaatggcaaacaggcatatgaaaggtgctcaacgtcattggtgatcagagatgcaaatcaaaactgcaatgagatatcaacccacctcagttaaaatggcttatatccaaaagacaggcaataacaaacgctggcaatgatgtggagtaaagggaatcatcatacactgttggtgggaacgtaaattaatacaaccactatgtagaacagtttggaggttcctcaaaaaactaaaaattgagctatcatacaatccagcaattccactgttggttacataaccaaaagaaaggaaatcagtacattgaagagatatctgcattcctgtttgttatagcactgtttacaatagctagaatttggaagccacctaagtgtccatcagcagatgaacgggtgaagaaaatgtggtacttatacaaaatggagtactattcagccataaaaaagaatgagatccagtcatttccaacaacatgggtggaacttgaagtcattatgctaagtgaaataagccaggcacagaaagacaaacagtgcatgttctcacttttttgtgggatctaaaaatcaaatcagttgaggtcatggacatagaaagtagaagaatgcttactagaggttgggaaatatagttgggggttgggaggctggtggagatgtgtaatgggtacaaaaaaatatagaaagaataaatatgacctattatttgatagtacaatagggtaactgtagtcaataataatttagttgtatattttttaataacttaaagaatgtaattggattgcttgaaacccaaaggatcagtgcctgaggcgatggataccccattccccttgatgtgcatatttcacattgcatgctgtatcaaaacacctcatgtaccccataaatatatatacctactatgtacccacaaaaatttgttttaataatttaaaaaactcttttaagattaaaaaataaaagcaaaaatattagttatgaaaatgaatataaatatattaaagttatttattaaaagatcaaggttcttaaactaggttagaaaaaactccagctatatactggattaaaaaatatatgtataaattaaaagtgaaaagattagcaaagatctaccaggtttatgtaaataaaaatatggtaaaaaggcttaggtaaataaaaaggcaaagtgtaggcaaaattcactagataaaacaaggaatgtaaatttagaatgccaaaaaagttagacttcacaataaaagtataagaggtagaaaccattatgtacttagaaactagtattaaactacatagctcttcaatgtactggcagaaataggtatatacacaattggagtcttcaaacagtgttttcattccttgataaatcaagtaggactaaaataaaacagatttagttaatgatttttagtctaattgttgtaatttaagttttacacttacatgagtacatatacttttcaaacatctctggagtatttttggaagttaatggtgtaatagaacaaaattataatttttataaaatcccacaaaggaaaagtacacagcccacattctaaatgtttattctaaaataaactagaaaatagtaccaagaatttaaaataggaaagtgtttatttgtaaattagaaaacatatacataaataactattggactaaagaaaagaacaattatgattatagattattcaaaaaataataatgattagaagattacatatcaaatcttacaagatagaactaaaactatcagtaggaaaagcagatttatgtgcttgctttattagagcatgagtaacataaaataattaagctgaattaaatttaagaagttaaaagatgaagttagcttttgaagccaaaaaaaaaccagcaaaaataaaagcaaagattaatgaaagcaaacactaaaaattatagtgttctggcaaattctggaaagtccagaaaaaagagagagagagccacagaaagagagagagagagttcacaaaaacaaataaatgagaaatgagttataactatagatatgagagactcttaaatgataagacaattttatatgcagttaagtttttttaattcacttatgttctgagaaaatataaatagctaagattaacttgataagtagtaaatctggataggcttttgtcaatagaaaaaaagttgaaaaaataattaattccaataaagtttctaagtgaaaaccattttactagtctttgcaattttttttttttttttaaacagggtctcactttgttatgcaggctggagtgcagtggcattatctcagctcactgcaaactctgcctcccgggttcaagtgatctccttcgtcagtctcccgggtagctgggattacaggcacgcaccagcatgctcagctaatttttgtagttttagtagacacagggtttcaccgtgtagcccaggctggtcttgaactcctggactcaagccatcagccctcaagtgatcctcccacctccacctcccaaagtgctgggattacaagtgtgagccaccacgctcagtctaagtctttgcaaattttaaaggaatagtttgcacatcgtatatactgtttcagtacaggaagagatggaaaacttacaaattccttgtagcattagcataaccataataatctaatgaagatagtgtggaagaaaaaaattacaaaccaatactacttatgaaggttgatgtaaattcataagtaaatttctagaaaactgaatgtgttacttaaacaataagaactggctggatatggtggctcatgcccataatcccagcattttggcaggcagaagtaggaggatcacttgaggccaggagttcaaaaccaacctcgtcaacatagcaagaccctatctctacaaaaataatttttttaaaattagccaggcatggtggtgcatgcctgtagtcccagctgctctggaggctgaggtagctggatcacttaagcccagaagtttgagactgcagtgagccatgaccatgccactgcactccagtctgggcagcagaatgagaccctgtctccaaaaaacaaacaactgtaaagggtctgacatcttaccctacttgcaagctaacaagttagcctgccagtttcatgtggcagaagaaatgagactttacggtcagagacaaaggattttgttgctcttggcatacacaggaaacagcataagcatcagtatgttcatcactgctcctgacccctcgcccacccgttctcaggtgggccatgtgatatgggcccaggtggacacctgcacattcagtggattgcattacaggagaggaagcctgagttcaggaaactcagatcttttaaaatgggcaataaacatgtgcctgctgcccgttgctccagagggagactttatgacactggatcagtaagaatgtttgtttgttgcaccagggagagacactatatttttaagtctgtaagcaaacctacccttcattatggaggaaaagcctctatccttgaaaacatactcccaaagagcagtcagtgcctgtgctcacaaggagtacagaaatgtgagagacccatggagaattgtctcccgacacatcattaaatattattcttaaaatgcaaggatggtttaatgtttgaaaatataataagacaaagaaaaataatataataaaattcaacatctagtgctggttgttaaagagaaaatattttttacaaatagacatattatttacttaaatatctattctaaagcaacaagaactgtcatgttttacagtgaaaacctgtaggcatttccattaaaatttaaacaaaataaggatgtccattataattgttatttaacactattctgggagttccagtcaataaaataaaaatgaaacatatgtaaaaattgtaaacaatgaaagccattattctaaatgatatatttatgcacagacaactcaggaggattaaaggaaaaactttaaaattaatgaggtcaataaagaaactacaaactaaataaaaatactttttaaaaattgtccacattgtccatatgccaacaataaccagttgttttaaacaatgtgaaatcataataactatttatataagaatctattcccaatagcctccaaacatataaaataatagaaataacctgaacaagaaagaatgccacattcatgaggacaaattcagtacctgagacatgcaagagaaaatatttaagaagaaataaattacaggttcctagatggaaaaaaggaattctgtaaagatattaaatacttccaaactgagttgcagatgaaactagattctaactacattcccactaagattttaggacagagatttgataaaataatttttaaatgtatgtggaagaatatcacatgatgataacaagtttctaaaaataaagagtactaaggtgggactcatccttctaaatattaaaatattccataaagctacagtaaaaacttcaacaaacaaataaaaacagagtgaaattacagaaaaattagtaggtagtgcaaaggagaaaaacagaaaccagaaacaggtttggaaaccagtggagaaaggatggtgttgagtcaactgtttgtttgttttttcttcaaaacaaaacaaaaaacttagaacggttctcttatatcaaataatttctggatgtcaaaagttatacttttaaaataaaaccatagaatctaaaggaaaatataggtgaaaatctatttattgggttggaaagacttcctaaacacaaaatcaagatggaataagtcacgaaggaaaataagaatagatttaactgcataaaaataaaaatctgtatatcccaaaagtcattataatgatattcaataactacaataaaatattatttaaaaaataacagacatattcaactatagaaaacaacatcaggtagagtttacaagtcaagctacaattggtgcaaaaaagtttgtgtgttatttatgatgtagaatagatgaagggcgatagactgaagtggctaggaacatgggagcaaatcccagctcccttacttgcgaggggctttcatcatgcctcagttccatcatctgtaaaatgataacaataatactatgacctcacagggttgttgggggaattatatgagaaaatgcagcttgacccagaataaatactaaataaatgttagcaatagtaacattagttgaggtatagggctataactattaatcgttacattttttttctcttgactcactatctcccctcatctaaattaggagcaagttgagaaacaactgcaggaatccagctgatgaacatctatctataatcctaaaggttggccgggcgtggtggctcacgcctgtgatcctagcactttgggaggcctaggcaggtggatcacctgaggtccagagttcgagaccagcctggccaacatggagaaaccccgcctctactaaaaatacaaaattagctgggcgtggtggcgcatgcctgtaatcccagctgctccggaggctgaggcaggagaatggcttgagcctgggagttagaggttgtggtgagccgagatagcgccattgcactccaccctgggcaacaagagtaagactccgtctcaaaaaaagaaaagaaaaaaaataaatcctaaaggttgactaaactgcattagagaagcagctcaacctgtggctacaagcctaccacttttccttcagaattaaacacttccatccccaactgcatgtctgccctacttagatgcctgaaattctactaacagagttagtagaatttaaagagttcttcctttaaattaaggcactgcaattggaaaagtctagtgtaaagtatgaatagcgctagaggcatactacctttcatcactttcagctatagcattgcaatattgattaatttgttatattttgtatctaattatattgctggttaaatcctgagtctcaatggaatgtgacacaggacaaatagatttgatagaagaaggaagtattaggatatgttctaaaggcttaaatcattttcaaaaaagctacacattaattaatttgattaactaactagaaaaatatgcccacactgattctgatggaaacataagtgatggtgctgattcaagtcctgctggccactcaccagctacacgtcctcatgcatgtcagcctcccaaagctctctttctctcctgttctgggaggacaatcgtgcagtatgttggtggagattccttcaaggacaaatcatgacacaaggattgagaacacgcttgggcagaaatcccagagagcaatgagagggaatggtaagtgagacaggagggacaggagacaaaccaataaagtggctgccatgaggttaccactaggccactgctgtcaatctttttgaagaccctctgggagacctgggaacctaccccagaattgtcccaccatggggaataggaagtcaagaaattttcccagaaattcctacccctcaaaggttgaggattactcctggactgagcacctctagcttagccctcaatttaccatcttctcaggaggcgagggcaccctctcaggcaaagggacacagctgtcatgccatctggcctgcatgagacctcctggagtaggcaaggagacagagagggcaccaaaggtattcactgcatgtacagccacttcttatagctgttgagctcacacagtgatggagaaaaatatgaatacaatgtgcaacataatgttaggcacacaatgaagggccaataaatggtaattgtggtggtgaatgctgctatattttttaaaatcaaggcaggcctaggtttagtgtcatagcgaaggagccaggcaccatagccagaagcccctgggtaggtctgggaagtcctaggaattgggaaaggtgaaaatagtacaggtatggggctgtaaaaggcaaacttcatgtcctgcagtgttctgcctgtggctggtcctgaggagcactggtgggtcagtttggccagacctccaaagagagccacaggaaaaaaagaaggctagaggtcctcatgacccacctcccaagatacaagcagacacttgaagtggaaaatccctgccactctgtaggacaagaactacgtggccaaaaagggaagctgcaataaatagttctggtttaacctgggatgcatcacagcttctccaaagttttgctttgactttaggcccaattcaaccaacatgaaacacccacaaattaactcccaggaaaaacatggctctttgagaaaagaactgacacttagtaagcagctgagcctgtcagtccaggttgcaggatggagcgagtgagctctcggcgggtacagtggcttgcactagctgaattcattactattccctttgtgcagccttgtgctttgaccactcgcatatatggaataggacttacaaaagaaaactgttttgtttggcaggtgggaaatcatttcaattgagatattttttctgtttactcaagtaaatataaagatgctttgattttccacaaagaaagagttgttatccctatttgaatttatgttgcttcaaaaacaaacatcttacttttagtatcagaagcagaccattctgttccttagggaagtgatattctttagtagactggtgggagacttgtagaatattaaaaggataagacaaattccagaataaataacagggaaaatttattttctgaactctaataactatgatctgttcctacagtagaatgggcattcaataactggaacatgaaggattggcctacagggaaagcccagggtggtctgggacctccctgaacctccagcagatctcatgagactgtctttaattatccttttctctctctctctccctctctcaggcctacaatgaacactgtgtggggaaaagaaagagagatcagactgttactgtgtctatgtagaaagaagtagacataagagactccattttgttctgtactaagaaaaattcttctgccttgagatgctgttaatctgtaaccctggccccaaccctgtgctcacagagacatgtgctgtgttgactcaaggtttaatggatttagggctatgcaggatgtgctttgttaaaaaagtgttgaaggcagtatgcttgttaaaagtcatcactattctctaatctcaagtacccagggacacaatacactgcagaaggctgcagggatctctgtctaggaaagccaggtattgtccaaggtttctccccatgtgatagcctgagatatggcctcgtgggaagggaaagacctgggaagggaaagacctgaccgtcacccagcccgacacccgtaaagggtctgtgctgaggaggattagtgaaagaggaaggcctctttgcagttaaaataagaggaaggcatctgtctcctgctcgtccctgggcaatgatgtctcggcgtaaaaccgactgtatgttctatttactgagataggagaaaactgccttagggctggaggtgagccgtgctagcagcaatattgctctttaatgcaccaaggtgtttctatacatgcacatcaaggcacagcacctttccttaaacttatttatgacacagagatctttgttcacatgtttcctgctgaccctctccccactattgccctattgtcctgccacatcctcctctccgagatggtagagataatgatcaataaatactgagggaactcagagaccagtgcctgccggtcctccgtaaactgtaagctgagtgcctccgtaagctgagcgccagtcccctaggcccacttttctttctctattctttgtctctgtgtctctttctcttctcagtctctcatcctacctgatgagaaacacccacaggtgtggaggggcaggccatcccttcactggacagaaccaatgtacttcttacatatattgattgattgatgtcacatgtctccctaaaatgcagaaaaccaagctgtgccccaaccacctcgtgtacatgtcatcaggacttcctgaggctgtgtcacaggtgcacatcctcaatcttggcaaaataaactttctaaattaactgagacttgtctcaaatttggggggttcatagtcctaaagtcattatcttatttaatggaaaagcattagggatgtttctactaacatcagaagcaagagataaatatctattatctctgctgctgttagagatattagccagtgcaattagataagagaaatcagtgaaaggcataagagtgactaaatgagtggtaaaactatatttgcagatgatataataatatatgtggaaaatcccagagaatcaataataaaactaactcaaacaataaaataatttactgaagaacacggatataaaattaacataaaaatcaatagccttcatacaaacaaacaggggacataatggtagagaaaacaccatttaaatagcatcaaaatatatgtatttatgaataaatataagtatttatgaataaatttaatgagttatgaaaacctatgcatggaaaatgtcaaaacactcctaacagacagtaataaaaacttgaataaaaggaaagacattcccaggttcttggatagaattatagctttatgaaaataccacttccccctaagttaatttataaatgtaatacaattccatcaaaatatgaacaggctattttctggagttagagattttgatactaaagttcatataaaaaaaaagatgggtaggaatgaggtagaaagacactgaaaaagaaaagctgtagtgattaggcttaccagaaattaaaacatttgataaagcctggataattaaaacagagtggtactggagcacagagaaataaagaagccagtggaagagaatagtccagaattagaccaaaatacatatggaaatttagtatatgatgaaagtggcatctcaaatcactagggtaaaacataccatatagcagtataaactccaagtggattagtgatgtaaatataaaaactaaaaccacatagtatagaaaataaatggctacattattatttagccttggtaagaaaaagcctttctaactatgatttaaaatccaggggcaattttttaaaagattaataaatttgactgcatttttttgtgtgatgaaaaccaccataaacaaaatcaaagaacaactaacatattgagagaaaatatttgtaacatacactagagaaaaagggctaatattccttatacattaaaaaaccttaaaaattgaaggacaaaatcctgagatgaaaatgaggaaaaggcataaacaaataattcatttgaaaaaaaaaggaaaagtttcaaaatggcttttaaatatgcagaaaatgcttaaactcactgataattaaggaaatccccttctcatttattgaattggcaaaaataaaacaaatatgagaatacattctgttgataaggcttgttggtgaagctatggggaaatgggcactttccctcttagaaatgcaaattggtacaacacttttggagggatattaggcaatatctaaccaaagtgcacatacatttcccttttcacctagcaatcccacttctagggtatgtatctctgacaatacaaaaatgtatatgaataaacttgcaattatcatttataattgcaaaacactggaaacaacttaaatgcccatacacagaagagtgcttgaataagctggaacaataacatggagtactatacaaacgtataaaagagtgaggaaagtctctagagtggatatggggtgctttccatgacatattaagtaagggaaaaacaacaacaaaacccaaacccaaaagatgtgattttgagttatgtgattccttgtgtaagaaatcagatataagaaaacacacaggtatctgatcctttatggaaaaaaaaaatcaagaacaataaacaggatttgaataaactcaaagtatctacctcaaaacacttatcagctacaaagagaaatacaataactgtatagttgtaaccacccaatgggttcttccagcctgctccccagagagagccaatttatcaagacagggcaattgcaatagagaaagttttacacatatagaactggctaaacaggagactagagttttattattacgcaaatcaaccgccctgaaaatttggagactatggttttttaaagatagtttaggaaaggggggtggctagggaatgggtgctgctgattgattgggggtgcaatcataggggtgtggaaaatggtcttcatgagctgctaagtccacttctgggtggagccgcaggaccagtttgtgggtctgggtggagccatccattttcagaaacgcaaaaatctgaaaaggcatctcaaaaggccaatcttaagttctacaacagtcatgttatctgcaggaacaactgggaagttgcaaatcttgtgacctctggaataatggttggtaattatttatatctacatgttaacagaattcaggttcctctcatcctcctaacctggtgatctttcatcagctttacacaaaggtggtttagttttgaggaacagatacaatcttttaaactataaactaaatttctcccaaagttaacttggcataagcccagaaatgagtaaggcattttggaggttaaaagcaagatgggggttggttagatcagatccctttcactgtcataattttctcactgttatagtttttgcaaaggtggtttcataatggagaaaacagcagacactaacctaatggagtgctcaaaataaataacaccattaataaggcatatatcagcatcatgaatcccttggcatgatgtgctgaaaagggatacagtatcatttctgcggtattcttgccaaaatggcatgacttcactctaatcatgacaaaacattagacaaacctaaagtgaaggacattctaccaaattactaatcagtgtatttataggtagacaggcataagcagggcaggagtgggcttttcccccacccactaaaaatgtcaggtgatggtttggcagttatcacattgcctctctaaaagtgataaattggcagccagcaccagggagaggccttttcctgatggtccacacctgttgcactaaagagtgaactgagtataggtgccagggaaacacaacttcctagacatgcgtattaggagataaaatggcagggtatgaccttccaagggcacgccatgagaaaagggaagaaagcctctaatgggcatgcatacaacttcctaaacacagtgcacatgctcatctcccaagggtaaggagggctctgtgcatgagggcagcctactttaagggaagaatcatgggaaagaggccagcctataaagtcttaggatcaaggttaaacactactcttgaccttcacatgcccacttgggtctcttccaagcatactttcctttctttcctgttctaaagcctttttaaataaactcccactcctactctgaaagttgccttgatctctttttctgccttatgcccctcagtcaaattctttcttctgagggggcaagaactgaggttgctgcagacctgtatggatttgccaccagtaactcggataccttccactggtaaaaatcagtatccttcaaagagtgccaaagttatgaaggataaggaaagactagggaactgtcacagattggagtcaactagggagaaatacaactcaatacaatgcggggtcccggataggctcctgaggcagaaaaatgatatttgggtctatggccataccaccctgaatgcacccaatcttgtctgatcttagaagctaagcagggttaggcctgttagtacttggatgggagaaaaatgatatttgcaggaaaactggtaaagatcagatgaagtctgtagcttagttaataatattgtaccaatgtcaatttcctattcttgataattaaaatgatgagagagattcaacataagtggaagcagggtaagggattaaaggaacactttctagtgtttttgcaatttcttaaagtctaaaattcattcaaaataaaataatgctttaaaaccaaaaataaataaatgaaatgggtctcttctattaagggttttctagaaacctccatctttccaccactctcctataaaagttttaaaacattttcaaaagccacttatcactattcttagactgccagtgatcaaaagggcagcctcgcgggttgcaaattagtgaagaagagaaagctagaaggaagaggaagtggagcatctgagggaaagatttttaaatgaacttctttgtgttgctaaatttattcgtatcctggaatgggctacaaccatcacaaggacataaaaatcatcaggtaaattcaaggactttttaaaaatgcatctaatcacctcctgtccaaaacattcaagcttaacctttctcttgaaaatgcaatctgctctttacaccctgcctgcataccagattctgagacctagattgccacaggagcagaaccatcaccttgtcctgattcaataggttcttgttgttacattatcagcttaagatcctggggtatgtggagatgtgcctattcattactgaaagagttcatgcacaatttatgtccttcacataactttgtccttaaaggctattttctgaatccatttcagttatgttttcccaacagccatattaggaggtgactgttgtttttccatattcaaagtaaaagaaatgagacaaatatctcaaaatgattgaggtgctcacaataaaaatgtagtggtaaagatagtaccagatctcgtgtctgtagcttctgtgccctctttcatagtccagaggactgagctactctagcaaatgggtatatgagaactggtgaccacagttaatccagctgacatgacaccagccattacattcaagtgcagtgatgtattttgcattgctcagctctttctacttttcaaagtcctcttcacatatttcattgaatttgattctcaaaccacattgtaatgtaagtagaatagctatttccttttagtaatcgtaacatcatgccattcaatatataaataaagcccctttattaacattaccttatctaggtcccactaaaagaaaaaatataaagtagtagtgtccccattttctagataactgaggctcaaagattgactggtccgaagacacccaggcaatgaaggggaagatggaatgtaagagcaagtctttttgactcattatccagtcatatttcccccactgtgcaatagctgcatagcaaaatgaagaaaaattacaagtttctgactatgagtccaaaaatgagttaacatgtgattttatgctagaagataatctaatgaggtcactctgcttagctgcttagctaccgctgttatcccaatgggactgggcaagaatagaaccaagtcatgcaagtaagagtagcacctgattgggcactgggcttggattcaggttgttatctctatggatagctgtggttcactgaggaaccattccaaagatgttagaagagccagacagaacctacattaattcattggttaaagctcagaaataatcatgaggtctctgagacaggagacaattagacataggatggctcctattatacacaaaatttcattgagtcagctctctccgctttacttcttgccctagtatatcttaaatatgtggttttccccttgcctaatccaggagagctggatttcataactaacaagactttagacttgtgcttcacctttcagcatgcttctgggttccatgatgtcccagagcctatgtgcttatgattaaaaaaaaaaaaagaaactgaagagggaccccagtctgcaggagtgagatgggcatgggaagaattacattttctctggttcctgggtatgctgaagatgacatccaggagaaaacttctggcccctcaaactgccccatagctcagcctgcgggctgcgacttacagtgacatcagcaacatgatggattccatcgccagcagcctggactccaggaggcaccccaggcgtggccgatgtgcacaggtaggagcatgtcctctgcgtggcctctgcactggaagagcttcaaggccttttcctccagggctgaggggatttgtgtttcgcctctgtttgtttttgtgtacttctgtttggcgaaactttcaagcacgcagagcaacgttctgatagatagtgcagagaggagctgcgcagcatcctggagccgaaagttacaaggaagagaccaaaaccggtaaagtcacggatgttgtggcccgaacctgtaaatccaaacaatctcacagttatgaaatggaaaatttgtggggaaaaacaaatgctttggttattacagtgttactacattcataaaatgtatttcatttgggggagtttacactgggggtaatgagatttttgctttatgcgttatttataaccgcttaatccacgtactgtgggtttttttaattccttcattttcacagctacaaaacacttcagcatttctaatttatttctgcttacaatacagatgttcttagttgtgtttctaactatatttcaaccgttacgatcacgtttgtttgtgtcagcgcgcaagccggggttgtatgtgcaatacacaatagtaaggcttcaagaagcctgtaaaaaggcctcttgtgctttcattatcaacaaattaaaatatgctgcatggcactatctttatcatcagtggttttaatctttggataattcccctgcagttgggtaggcagagtgacagccctctctcagtgtagaaagactgcatgccttaaaatggcacttttcaagatgaccatttggaagcaacatttggagaacatttgggttatgtcctctaactgaatttccaagctgttggtaacggactaaagaaaatgtagtctgtactgaatattaaggaagcaagagtgtaagagccttgaaggtcatgtgtaaatattgacattttattttatttagtaaccaaattggggcccttgcattgcttatcttgccataaaaactcctcactcactttcactgccctgcagattgtcagggaaagatctgatctgagcagctctgggtgctcttcctgccattgctaacaagactgaattttgtttgtgcaaaatctgagtcagaggggtgttcctcccctctcatctccaccacggactgatgcacctgattagataacagaaatttgtgggctgaatgttcatgtagtgacatgaaagccaagatgcaaaaacagtcagagaaaacagcctcccactcactcagagtcaagtcaggtgtctaaaaccaaagttatctggggaaccaataactggctaatttggccagaatacccttctctgtgtcctcagcagcagtgtgaggaagaaataccagcatgtcctcaggccctgtacccttctcagaaaccaggactctacctgcagagcttaatcagggccatattctgaaggtgagatgcaggcaatggccaggtctctccaccagcagcagtggctagaatgccccacacacttaacaacttccgggacacatttgactgttgacctacaacagcattgctttcctctgccaaagcaaagagctctgctcatgtagaataggctggcagtttggtaacttgccagaggctcctgtctccctacagtgaggtcaccagaatcgcttccctcctgaaacacagtcgattgaaatgaaggtccagcagaaattaggggccagtgagttaaacatggaggccacttccaatggtctttagcctaagaggttttctccaagtgaaaagaagaaaattgaatatgggaataaaatgatcttttaatgcttcataactcaactctctgacttacctcaaaaagagagaaatagtgtaaaaaaccaacactgttttctgccctctaaatttgagttttgaaaggtgctcctcaaatattaatgatctggtttctgtgcccaaataaatgtcatgatttacaactcatgcttatggttgcaatcctaatcacccttccctacggcagctttataagtcttgcccagttccactactgaaatagtgcacttggattcaaacaacactcaaaaaccttgttttttgttttgtttcatttttaactattactgagtggacagggtcaatcccattcaaaattcccaagtagacaaaatctgtctgtggcccctccccttcccctcaccttcttggccgcctccctccattcccactgatgaacttccaagcttcctacagctccactagtccttttcaaccaatggaaaacaaagcagtttcctacattagtgtatctgccttcataaagtagtttagtgttttgcacaaaccaagagaatgttcattttaaaagcaggaaagaaagattacagatggaatgtcagacaccagggcacctggataaaatataatttggggcaggggagtatattctcatcttacctaaagtagacgaaccagtcaagtcagtacccataaggtaggcttgataaatctcaggaccaggcacctccacccccaacaaacacacacacacctttccactgtgatgttttaggcacagtgtattgtagctctgcctatctactcagaacctaatgtattcacatgaaagtaaactaacagagtctggctgtcctggtgattctcaagaccctattgcctcctcacttacccaaaaggaaaggagcagtagttttgttttttttttttttaattcaagaaatcagcaaaaaaaaaaaaaatgtgttagtgtttctccaaaacttctaagttagagtggcacaattcattttttttaataaagaatttgattaactctggttggcccagatttgcttcagcctaaagcccaacatctcttttgcagcgtggtatccttcagttgctcatacttgagccaatagaggtgggaggggagatggagaagactggttttatttgagcttgtgaaaatggctttttatcaagttcaatgtcataagttttcttccacaggaaagtagaatatattttctggtgagcaatagttttttattatatagaaatggttcctaattcttagcagacagggatttgagaaaacaggggagttctccgaagtcacaacaaataatgtgatggtcaacgtgatagactattgtacgctttgatagctagtttcagactgattttctgacacatgagagaggagcagtgcctgttgcccatggaaggcgatttgctgggaggaggaacacaaacatccccaaaggctaccaggtcaactgtcattttcaaaattaccattaaaagtaggctggtgggccgggcacggtggctcatgccagtaattccagcactttgggaagccgaggcggtcgtattacaaggtcaggagttcgagaccagcctggccaacatggtgaaaccccatctctactcgaaatacaaaagttagccagatgtggtggctggtgcctgtggtcccagctactcaggaggctgaggcaggagaattgtttgagcccaggaaacagaggtagcagtgagccaagattgtgccattgcactccagcctgggcgacagagtgagactccgtctcaaaacaaaaaacaaacaaacaacaacaacaaaaaaaaacaaaaaaaaacccacaataattagctgagtgtggtggtaggtgcctgtagacccagttaactgggggttgacgcaggagaatcgcttgaacccgggaggctgcagtaaactgagatgaagccactgcgctccagcctgggctgcagagcaagactctatctcaaaaaaaaaaaaaaaaaaaaaagtaggctgggcatggtggctcatgcctataatcctagcattttgggaggctaaggtgggaggatcacctgaggtcaggagtttgagaccagcctgggcaacatagtaagaccctgtcactacaaaaaataagaaacaattacctaagcatggtggtgtatgccagtagtccagaaattcaagattacagtgtgctatggcaccactacactccatcctgagcaacagacaaagaccttgtctctgaaaaaaaagaaaagaaaaaaattattattaaaagtaataagaatagaaaacataggctgtgtatgctagattaacaaaacattccccctacaaaagggggaaatttcaattttctatgaagtttgaaatctataatcatctggcattatttccaggcatgtagaaaaaaattcatttgtcttttcatctggattagtttgtctccatcagtgtgtacatcaaaagtacctggggattctgtgggtttggggaacatttttttgtttgcttgtttgtttgttttcaaaatatatggtagtatcccaccacaaatctatactaaaataaaatttcgcagtgtatgtcaaataaatgtgcactttgaaaaattccccaagtaaattttgagattggctcttgattcagtgacactaatataaacactttcacttacttttgaattttgtggtgaccgatcttaagatttgaagcctacaccttcttaacttggtccatgggggcacaaaaggagagagagtataaatgctgaggatgaccttaacaaaagtgaacacgaaattaagagatgtgaacccaaaataaaagaaagcaaagaactctgtcttcccttgtcatctttaactctgctctatcttgattcttctctgtgtttttcacaggctcttcttcctatacccactctgtaaagtgatttaccccatagctctccacccctttcaccttggatctctggtcagataatctcaccttcctctgtggcttcaaagccatatacatttgacttctgaattcatctgctagggcagccataacaaagtaccacagactgacttgggtggcttaaacaacagaaatgtattttctcacagctttggaggctgaaagtccaagagaaggtatttgtggctttggtttcttctggggcctctctccctggcttgtagatggctgtctttagcctgtgtccttacaggacctttcctctgtgctggcacttctggtgtctcttccccttcttacaaggacatcagttctgtagaattatgggccaccctaataactccattttaacttattacctcttaaagaccctaatatggtttggctctgtttccccatccaaatctcatgttgaattgtaattcccagtgttgaaggaggggcctggtaggaggtgattgaatcacgggggggcggacttccaccttcccgttcttgtgatagagttctcaccagatctggttgtttgaaagtgtgtagcacctcccactttgctctcgctctgttctgctggccatgagaaaatgtacctgtttcccctttgccttccgccatgattttaagtttcctaaggcctcctcagccctgcttctggtacaacctgcagaatggtgagtcgattaaacatcttttcttcataaattacccagtctcaggtatgtctttatagcagtgtgagaagggactaatacagaaaatttgtaccaaatagtgaggcattgctataatgaaacctgaaaatgtggaagcagctttggaactgagtaatgtacaaaggttggagcagtttggagggttcagaagaagataggaagatgagggaaggtttggaacttcctagagacttgttgaatgattttgacaaaaatgctgacagtaatatggacagagatagccaagctggtctcagatggagatgagggacttactgggaactgaagtaaaggtcactcttgctatactttagtaaagagactagtggcattgtggccctgtgctagagatctgtggaactttgaacttgaaagagattatttagggtatctggcaaaagaaatttctaagcagcaaagcattcatgatgtggcctggctgcatctaacagcataaactaatatgcatgcacaaggagataatttgatactggaaattacacttaaaagggaagcagagcataaaagtttggaaaatttataccctggccatgtggtagaaaagaaaaacccattttctggggagaaatttaagccagctgcagaaatttgcataagtaaagaggagccacatgctaatagcaatagccaagaccatggggaaatgcctccgaggcatttcagagatgcctcggaggcatttccgagacctttgcagccgcccctcccatcacaggtctggaagcataggagggttatatggtttcatgggtcaggcccagggccctgctactctgcgcagcctcaggacatggttccctgcatcccggctgctccagctctagccatggttcaaagggccccagatatgtcttaggctgctgctccagagggtgaaagttgcaagcctcatggcttccatgtagtgttaagcctgtgggtacacagagggcaagagttgaggcttgggagcctccacctagatttcagaagatgtatggaaatgcctgaatgtccaggcagaagactgctgtaggggcagagccttcagggagaacctctactggtgcagtatggaggggaaatatggtcttggaacctccacacaaagttcccacttgggaattgcctaatggagctttgaagagagggccaccatcctccagactcagaatggtaaatccaccaacaactttaagctccattattttggagctttaagacttaatgactgccttgctgggtttccgacttgcatagggcctgtatcctctatattttggaatgggagcatttacccaatgcctgtaccccccattgtatctgggaagtaactaacttgtttttgattttacaggctcatatttggaagggacttaaccttgtctcagaagaaaatttggacatggacttttgagttaatgctggaatgaattaagactttggggaactgttgggaaggcataattgtgttttgaaatgtaagaaggacatgagatttgggaggggctggggcagaataaaatggtttggctgtgtgttcccacccaaatctcatgtctaactgtaattcctagagttgggggaggggcctggtgggaggtgactgaatcctgggggttgactttccccttgctgttctcctgatagagttctcgcaaggtctggttgttagaaagtgtgtagcgcctccccctttgctctctctctctttcctgccagccatgtgaagatgtgtctgcttcttcaccttccaccatgattgtaagttttctaaagcctccccagccatgtttcctgtacagcctgcagaactgtgaatcaattaaacctcttttcttcatatattatccagcctcaggtatgtctttatagcagtgtgaaaacaaactaatgcagaccctgttcccaaatacagtcacattctgaggcactgggggctgggaattcaacatatgaatctggagagacatggttcagaacataacaacttccagttatataacttcaatgctacgtgatgactggctcatatatttgaaaaactttcacatgaaaaagggacaagacaaggaccaatgtgtggaaggtaaaagctgaaattttcagctgaacaaaaggaaggcctatgtgataatgaggggggtctagttattacaggctgcattccctgatagtgtgtccctgccacaggaagggcacagcagaggctgagtggaccactatcgtgcctgtctttggggaaatccagcataagcctccaaaatcccttttcctcttttaatttgatgacattaatgaaggaatatgagctcacagggattaaatcaagatgattaaaacaaagaagtagaaaatatgatcacacgtctacagtgtgtctacaaacacggcataatcagatatgagaaaaaggagttttgtgaaatgttagagtcacaccctccctgacgtgagcaatacagtggccagcaaggcaggagaggatgtgctctgtatcaagaatgtgaggcctacggtaaagctgaccggtacaggtggagcaagaccaactaagaagcatctttccctggagaaaactgtcactcatcaagaggatgtccatggcaatctaagtggagattttcccaaagggactacaaatgtcagaacccaggtgatctgacatcaatgaatcttcctgaaagccccttgggatgtcatctgatgacatgagttagcattggtggactagggttggaagatctgacttgagagccaatttctctgtgtacactagtcagctgacctaaggtgtgtcattgccttctctgagtctcaagctcctcatctgtaaaatagaaagaatatggccttaccctgacagcatattgtaaaaattgatgagatatgatttaactataaatgtgctatgaatttaaccatgcagtttaatttatgtaactgtgaattgtagactcttatttaaacatgtggtattaatattattgtcatgttttcattttgcccaatgtgatggtcaataccgtgtgctataaatgtaagtgagctcctcattagatgcagcatgaaagattctgagggatgccctttgataatttgattcgctcaaaaagatacagacttcctagtcacaatggggaaagtaatccagtggaggtattcatattccaaaataccactgggagatacagaggaataaaaaattaagaaattccatacatcagaaggacaagagctcttgaggttctttcagtggacagtggttttagacttcactgtgcattagttctgtccaagatgcttattacagatgaaggctctccttcactagaagccctccccatcactactcttgattgcatggttcagtaggacaatactttgaaaaacatttccctggtgagtgaattcaaaccctcagaagagggattccatgcttcatacaacactatggaggctttgaagtgtttaccatacttgggttctattggcaatatccaggggtgacttggagtttccttaaggttcctctcaaaaatttccatttacttaactccgagatatgtcaaaataagcattcaagctaagtaaaaaattggtgcttgttagacaaagccgcttcaagacaatgcccttgatccttcctcctctccagggtgccaccctaaacccctctacctagaaattttggatttgccaattgcccagaaggatgaaagcctcacagtgcaatcattgtcaagtcctgctgagctgtgtgggagctggcttatgtggaactgcctgagcttctcaggggcctcctcctggcacatcgagctcagatgaaatggaaggcctcaaagccccactcaccccaccctacccaccttcatttataccagttcacagaagaataaggaaaacagacaaataccgtatctggaagatatctccaaagacctaaagccctaaataggaaactgagaaatttgtgggaacctttagaattttgatctcttcatacacactgctagtcactgttactgagaaagtagcaagaccagctttttccattcattgtcatctgctcttgacatgctggactcacctgctgtgtctccagatcatgtgcatggctgcatgcagtctagggttctccaccaacaggcagatccacctcaataaaggaaattacttgaatcagtgagggacaactaacatcaggtgacattttaaggtaaactcttttatggctatactatttctgtctttactaagtatacttgtaatctgatcagtagagtataagtagcctgctctctcataatatttttgtagaaatcaatacagtgtaatcaaattggtgtcaataggttagattccttatttgtaattattgagggttttcatatcttcattgaaagactattggtttacatcatgccatttgacttttggttcaagtgctttcaaagaaactgatttcttaaaatgcatccttgcaagcctgacagtctaacagttgaaaatctatgcaagaccataaggcagactaaagatgggtgagaaggcagggatgggggtaaccaaggacagagatactaagtatacaaatagatgttttccagccaaagctggaggagcaaatggagcaactgctaataaaaagtgggcatgtacattttgatttcaatatttaaaagtagcccagtgttccattaaaaaaaatgcagccactattcaaggaaaaaaatgtgtgtaatatgtatgtgtgtgttacattaagaaaggagttccacttcaatttctgggcttcataagcaatcatccttgtgatctttcgtttgtgcagtttcatagtctacaaaacactttcacaaatattacttattcatccaacaaacatttattgagttcttcctcacccccaagcattgtgccagacactggagatacaaatatcaagaaataatacttaccttcaagaagtccacagaagcaatctgcaatctcttaccctcaacaaatttaaggaacagaaatatctttgcaaagaacagaatgggaagatgattttttaacttacaatgccctgctacaatccagatttccaaaaccctaggaatgataaaggagagaaaaagatcatgaatttcccaatattttgagaaagccattatactgcttctcattcattagactccattgctaatcactggagtttcatactgtttaaggaggcattcctccaatgcctttctgaaagtttctagggatgtcctaatacctacagacatctccatttgccatacacctggactgaaaggggatagtattctctctccttaattgtaataggttaggcattcaattgacaaataaaccttgagtacattaacttaaaacataattgaggatcagctatgatgtgtcatgcactgattggaattataagagatgagtaagtccatgccccttgatcacaagtaacccagaaagggagaaatatttacaaaaagctaggtaaaataaaatgtaaagcaactgctctccagtagtgggaagggcatgccctagggcagactttttcacctagctaaacttcccaacctctgactcctgtcttcgccatgctacacgtggtaggacgagcatccgaaacagacagctgacatgctttaggcactgtgttgtgtgcacttagattcttcaaaattctggaatgggaatatgtcctctcagcccattaggaaacaagccagcctaacttcactttttaaaaaaaatctcatcagattcatcttattttgataggaatattgagttaggtgactagaaagatatagggaatcttgacttgaacaagaattctgagaaagtctcaagatttcttgctggtcaagctggaaaataatttgtaccaaatgataccacacaagattaattcataatatttaaatgacagtgccctaagggtgctggtgagcctagaggaaagtttctaaagatatttctttgcctgtgcccttagctctgtattatccaaatatgttacacaacaattcagatgaaggtatagaaatcatgcacaattaaaatgccaatgaatgtttaaaatcttagaatatggcaaataactggcactgtgctggctcatgataaatatatgtttgactttctaaaatgaatgaatgaatgaatgaatgaatggcttatacagatttgaaaaggaactaacactaaagaaatcacatgtaatgggataaatttaagatcctgcactagtatccaaaactaaatactaaagcacaacacacaagaggagagattttactgagaagtttaattggagatagtcattccccatccctgaaaaaaaaaaaaaaaagatacataaacaaaacaactcatatcctacctttagactgcattaatagaaacataatacctagaatgaaggagatgatagtttactttgcactatcaggtcacatcgggggtgttttgttcaattctggatgctacacactgaactgacttcaggaaaaatagaacagtgaataggctaaacagcatgtgatgtgagacataatttattgtgtctgattatcattataatcataaaaagaactaagtgccaagtgctttacatgcattttctcgtttagttctcacaacattttgcctatgaggcaagtactattattatccccatttcacaaaaagaaaataaaggctgagagaggccaggcaacttgcccaaagtcagagaggtgatggggggtgggcagccaggaatctcaacaaggcttctcttgttctagagctaacacacataggaaggggagatagagccgggtgcagtggctcatgtctgtaatcccagagctttgagagaccaaggccggaggatcacttgaggccaggtgttcaagaccagcctgggtgacatagcaagaccgccatctctacaaaaaaattaaaaattaaaaattagctgggtgtggtggcacatgcctgtagtcccaattactcaggaggcagaggtggaaggattgcttgagcccaggtgtttgaggctgcagtgagctataattgtgccactgcactccagcctgggtgacagaatgagacgttgtctgaaaaaaaagaggagaagacaaatattagaaagactaccacttggaaataggattggtgcatagtcatactgactataaaagggagcactaaaaccaaagaatgggaaaattggcccgttacgtggaaaaatgtacagtaattcttttaggtgtctcacacagatcccttcccaggcttttcaaccccatttcaaatcaaattgactatttccttgaacaagggcaattatattaattgcaaagagttttctgtttgccatctaccaaaggttacagctcaaacatttaaggtagtgtctttctgttggccacatttctctgtctctttctatttctgttcctattaactactgcacggatctgaataatgcaaatattaaagatgttagctttgactttacaaaatatatcagctataggtgcccttgaaagccaggacttgctccttcccttggtgccaccttgaaaccaggatgggaaatttgcaggtcaccctaggttttgaaaagaagcgatccatttccaagttgcaatctacttgaaataatctccccagttacgtggaagtaatttattccatatttactttctgctttggattatcaaatatctcttcctcttacccccgggggcagcatttgggattaaaaaacttctactacctgccctgctggggctgcattatttaactctttcatgcctatttaagagcaggcaaaatttgcagcaaatgataactgaagtccctactagccctaagatgtattattctacgttaactttatttgttttagatgtactctatttccaaaactgtttattatttttagcaacatttttttaacaacactgaggctgacctatataaagttaagcagctgaaagtaaaatatttaagtaacaagttgacccatgcaatgccaaactaaagagtagatgtattgtttattccagggtcagacgaaggtcaagtggtgctaaacctagaggtcccctcatttgggtcaagtctcactttccacatgaatggattgccaccaatgaaggcagccaggggactgttttgtttcaaattccctgtcctgggtgtagccctccaaatatcagtgcttgcttgttgaacttcttatggagaagaagaaaagtcttttaaaaataaatcttggaccctcacatctcagagccatgggcgagcctgacttgcttttgtttttaataatagactaccttttagagttgttttaggtttacaggaaagttaggcagaaagtatgaagagttcccatataccctcttcctaccctacccctactcccacagtttcctctattattaacatcttgcattgaacatgactcttttttttttttttttttttttttgagacaaggtcttgctatgttgcacaacctggacttgaactcctgggctcgactgatccacccaccacagcctacggagtagctgggactacaggagcaccccgtcaggcccgactgagcatgaccttttgacagagtagtccaggtttgctattcttaagttccctgaccttaagatggcaaagaatactgtaaggcccatccctgttccaaataggactcactcaatctgtagaccttaaccagcttctagggccaaggcattcctcctactaagaagcctttgtcacaacaacaggaacctgacccagacgcaacctcccctaaaaacaagccagacaagagagtgggcagggagcagacagcaggaacaggctctggcgagggcctgagaacagcaagtttcaacgaggtacttttgaagagattgttggctacattatcttatttaattaccgtggcataatccttacatggctaaactatttatcaaaaacaaggctgtgcaacaattcagcaaatgtcactgtgttgttattggtgaaagttgctcccacaaactgctctttcggggtgtgctgtgctaggaagagccttttccaggtgcctggccattcttctgcaccagtttttaattgctaatgaattaaactttccaaagagataagaataatgttgttttgtttgcgcacagattgcatgactaacaaggacgatataaataaaaccattccaagctttatctgtgggtggacaacagtgcctgtgttcaagtgaagcctgagatggctcccacacaagattaggttgttattgcggaagctgaggcttgcacactgttaaaagcccgagctaatatgttcgcttaagacattatgcctaattatgctatgtgtcagtaagggaacctgttccccaaacgttaaactatcctgaagcaccagtgtgggtctgagccaagtggactctgtaggattctgagctaactatgctccatggtgtttatgaaaatgggtaagatctgatcctggtgcattctctaccttcaggatgatatgtattcctacttggaccagtaactatcttaacaaatatatgtgaggagaaatgtttgtgcttttatttttggaaacttaccataaaaatctgcaaacatttcctataaaatgcagagttctctgtccatcaagttgtttgggggcactgaggaaggagatgtttatttatgagtttgtttccagttcaaaaaaggaatgccttcatgagcaggagaaatgactgaggtctggatttctgagtcatgatttgggcttggctcgtggttttaggagagttgaacatcctttagctaatgtttcttgtctctatgcgggtggggtgtgctatgataagaacactagccttgttttggctgaatgttgagtgcaagaatcctttgctgacctaagaccatctagaactgctagaaattcagaatggctagaaatgtatgtgttgtgtgtgcctttctctttgttccaaccctaaccttaattgtgtgtgtgtgtgtgtgcacgcacacgcggtcaagtcaagcagggtagaaatctgaggcactggtagcccactgggatgcctttgtctgggattcactcaccatcagtcaagaggcttcaaaaattaatttaatttgattaatgggagattgaaatcccacaccaaggccttaggaaatctcatggtgaattaagtcacatggatcatttcatacctcaaacttcctgtggcttccagggagaatccataatctccaggagttggtgaggcaatcattcacccctagacacatctggactctgactgcaacaggtagaatcttgactctgtccagccatccacatctctactcccagcctctttccatatattttccaaaatacttaaagtcaccctgaatgcccctcttagcacttaatgctcagtatcatcatttaagctcattttacaatttttcaatgtgtctagaagtgtcctcattatttcctaaaacaatatccttttccctgcaccccacatttcttcctagaggatgcccattctctcctctcccttccatcagagctctaaccaaagcccatggttgctccctactctctgacttcaattcctcattcttcctcattctcactttcactgatgcatgctctaatcacctcagttctcctagtctttcatcattctaacccactcataaatactatttgtatttgtttacacactcagtcaagaactttttactgtcatatctggctcaacatttttcctgcctctgtgtcaatttggttcccttttttgttctaaatgtatcatccactattcatcctttcatctaaatccatctttccatccatctacttcacaattatttatggagcacctaatgggctttatggactgctttaagcactgagaataagaaggtgaataggtggcagcccctattcccaaggagttcacaggggaagatggatgcacatacatcacatgtggttaattatctgggtgtgataaaggcaatgagagaggagcacagaggaccagtctagaccagggcaggggaaggtaatcagagcagtcagctcctcctccccagccaggctggtctttctgcaaaaccatcactcctcagttcatggcttcccatgccgtgtacctgaaatgccctttctatccaaatcttggctattttacaagatcagaggtattctactctacctctgggaacttttggacttattcatagcatccaatttaggaattctttgatacatgatgctttgccttctcaaataggttacggcttcgaatttaaggagagatcattgtgtctcagtacttttgtgttccttacactgtgctaccaaaaacactgaattaaaaaacaggacatggataattcattcctagattttcctgaccatcttaccttttctgccaacatgagtaacaccttatctatatgtagtaggcacttaataaaataaagacattgtgagacattggaaagaataagaacttcaaactcaagttcaaattctaattcaattactggctgtttggacttaggcaactttatcttttctgagcctcaggctccttaaatgcaaaatgaggactaataacacaaactttatttctatttaggggacgattaaatgaatctgtatatgtaaaatgcctagcactgtgctttgcatatattaaggaatcaaaatatgctagatcctgtccctccctctattcttcgtcccctctccatccccaacccttcatgccaggcaaaatttggcaagaagcaatagagacatttaaaactttaacacctgcatgcttttggttgcaaaacagtgcttaagcttttctcaaactcccaacataaagcctgggaaggacctagatttgttcatcacacccagcttgtcacagggaaaatcttggtgtatgtattactcagtcttatgtgggcataaatgtgataaaagttctgtgatctttgaattttatggctctcaaaaacatgtgacactctacattttttactgcccttcgtcagtcagctgattttgagacctagggaaacccctgtacgttcttcgacccacagaaagggttaaagattcctactacaaaaggactcagtgttctaactctaaatgtcttgggaacatggcctggaaaggctgagggccattgcattacacaattacctatttgctggagacagtatatttaataactaatcatctaatctaataatactgaagaatatcagactcaaaggtcaagtgtttaagattagggagaaagcagccttaaaagtacattttaaagagcctcacaggtcaacaagtcagccttagagcctgccatgcaaccaccacttccaggctgctaggggaatcagaaatgtcactatctttcaaacttagaatattgattatatccactctactcataggggctttattccatgacatctcttagttagcaatttaagaaaatgatttcatcctatataatgccagattagctcaatgacaaaaaatgttacactaggagctcttcgatacacacttgagagctcttacccaaaatgttattttccctctggactttcctgtgttgataagttctgtttgcttccaattgtggttcactcttgtggatctttttctcagagacctaagtgatcatcattcctagagatatttgtggtacaaattctttattttcaagttctgaaaacctcatactaaaaagtcaccctttatttctcacttttaaaagcctgaatgggcactcttcctcatctttcatgaagttaaagtcttgtcacaattcaaattccctagatgaatcccttaaagaatcactacacagtgctgactctccaatgtgcacacttgaccagcaggacgtgtatgtttatttcaaatatttgagtccttttgcttgatcttttcataagttggtctcacttcagtcccctgatggctttaaatcgtggtactttgctcacaatttctcagagtagaacatttttagagaaagatctagacatctctgctttttctaggaaaaataaaaacataaaaactaaaaaccccgcaactctcaggatagaccggattatgctgaggtaacaaattaaccctaaaatcccagtggatcatcaaaacaaaggtttctattttgtttcactacatgctcatcacaagttagtgagatgctctgctcctagggctactcaggcaccaggagcaactccaggtagttcctcagggacccaggctgaaggtgattacaccatctggtcatgtccctactgtagaagacaaagaggacctcatagcattcttctatgcctaggcccagaatgtacattgtcccacttcagtttatagcccattagctagtgcaagtcacaagtcccctaagtaccaggaaatgtggtcttttctgtgtgcagaaacaagagaagaacaaaaaaagtatgcaaacacactcacatcaccattgcctacattaagattttatgcttcaagaagagtgaagccaacagaaaaggctgaacataaaggaaatctctaagcctggacacccggtggatccagaataaccaaaacataattaaaatacttactgagcacttactgagtacttttctcaagattaatgcaaatttctattctgcctttaattccttgatttttaaaaatattttaagatttttgccaagcttttacattttaggttataaaagaatttccaaggcctggtatggtggctcatgcctgtaatcccaacactttgagaggccaagatgagaggatcacttgagcccaagagttcaagaccagcttgggcaacatagtgagatcccatctctacagaagataataaaatttaaaaattaggagggcatagtggcatgtgcctgtagtaccagctactcaggaggctgaggtgggaaggtcacttgagcccaggtggttgaggctgctgtgagctatgatggcaccactgcactccagcttgggcaatagggcaagaccctgtccaaaaaaaaaaaaaaaaaagaaaagaaaagaaaagaaaaaagaaatgatcttccaagaagaaaggttgatactaatttttaaatgtaaggtcaatcactacttggttcacattaaattttctagcaaatcttgtgttcctcatttgcaagatttgcttctgatttgctagatttgcttccggatttcccttggtttgcttctctttgttcagaagataaattcacactcaaagtagcacagggcctgacatagatgtaaatgctaagcatatataccaatgcttaggaataacaaataaatgagtgtgaaattagaagcatcactaccaagaatatttatacaaatatctagacttatactccatgctacaacaataaaatccaaaatcaatgtgtcttacctttcgcatacgatcattaatgccaaagggcagtactgatttcattaaaagaacaattagaaaagatgaagagagattttcctgttttcctccaattttgaatctgtcctccttttcccattttccccattttcacagattcttatgataaagttttcatttctcaaggagccaacgtcaccccagactcacacaagggaacacaactgtgttatcattgcttgtctgaaggaagggaagtcaccaatcctccttcaaacaggaaaccttgtggaaaataattgtgaatgtagagcacacctgagcagaaaaaaaatgctgaccagaactgtgcaataagtttcttccatgttggaagagtttgacttacaactcagccattctctgctgcttatataagagcaaagtcacgtcaaaaaagaagccaaaggaaacagaatgttctccattgcaggaatgactgaagtttcgccaattaaacttttccttaggcatgaacataagtaataacctaacatatcctgagtactactttgtgctatgcagcctgctaaacacactacatgcattaaggttattgaaagtggaagtaatgctcccagtatttgtgcaggataaaaagaaaatattaaattatttgtttttgtttattttgtaaccttattatttagtttacttttttgcattttattatttacatcatactgtatatagtatattggtacctatataaaataaatatatactcacacacacatatgttgagagcatacgaatagcagttgcagctcagtttatttttaatcaatgagaaaggattattattattattgttagttatcattattcctgtttgcagaaaaggaaactgaggcttaaagaggttaaaaggacttacccaaagtgtcaaagttggtaaatggcagagctggaattcaaagagtctgattccaaagtctatatagtccggcgtgatcattaaaggaattccttgtgttcaaagagcagtgcttgaaaaccaagctcatttgtgcctgcagaaatgccagcctctggggtagaagaaatgtcatactttgatcatcttccacactgaattaggaggaaaagcagaagaaaagaaactgagggtaccaatgccagacagtcactaggtagtaaatggaaaagaatttaaagaaagtgaaaatcaaaggaaaatatcacaacgtttggttgacaccctattcctcacccagccccttaatgtctttctacagaaatcagatttctggtgcaggcagttcattgtttgaacatgcagtaatggacacatccagattcctaacactggggagttcagagtcaatcaacatggattgagacacttacagcttcatcttttgctgattgagcactgaggggtgtgtatccccatgcggtccctaagagctacacccacgggagaaacattttatgttgttcaaaatacttggtgctatggttgttatcttcaattttcttaactagtaatgagtgatcctagtaagtgttaaaccaatatgcactaggctctctttaggatattcattacggaaggctttgaagctgagaaagaagtttagagtttagggaaaatttttaaaacaactctatattataggcattttaaaaaataagtgcaatggaattctttagaggtaaccaagtttctcaggatatctttgaggcagtgataaagatttaagtttttaaaatcactatcaaacccctttgtgcaacatttgcataaattctcaaacaatgggactgttttcatgtaaatttgttttcagggagattcctgctttctgaaggcagtgtaactgtagctgagttacataaagtgacattttattgcctcctgtggaagatgctttgcactaatgatctgaaatctgatgtctcaagctaggaattagatgatctgtggctcaaagtgtgaaaagagaaagtggggcctttatgttttagttaattacttctggctaaaatgtggggagcgctccctggaccttctgggactcctggaatccggaaacctgtctacaaaacctaaaggattgaagcagttgacctcatcacaggagtgaccacagggggaaaaaacagtgattcacaaatccaagcctgatttcagtcagaaatttttctgtgtttcataaatctgccttttttctctaactgcccttgccacctagcaagccaggaacagagagaccaaaaatcatcataaatatggaatatgcagtcggaaatgtgaaaaaagagcttgctacccagggagaacaaagctttcacccctctggggcttcactgtgaaaaagaaacaactctgcttgttttgtcttattttcccagatacttctatttgaaaaatatagtaaatcaattaatcaatttttctctccctactatccacgccccctcatttctccagttctctaattctctaattcctgagttgtctaattcctgagtactcctagggcagttcagcttactacaagagaattttttgtggctgttctcaaactccatattctgtttgcagagaatgctgttccttaattctgtttgagtttcaaagagaaaaagctcataccagtttagattacccacaatcctcaatgcatatcgaacaaaattgtcattcctaatggcaaagttcaggatataactgtgttagttaatttaatcatttaccatgaaataccaggtgtcttaatcttatatatagttcttaagttggctgcatatttttgtgcaattgaatactgaccctacatgaagaatacaagaattttgtttttaagtaaatgttgttagaaataaaatgtttctactggaaaaaaaaatatgttattagaagcactgtgaatttttctccaatgcttgaagagtgaccactccagcaagcctggcttatgttggtggcattctgccctgccactacctccagcacatccacagacctttatttttgttattttatgaccacatgcaggattctggcaccaaggactccatttggacttaggaaaagtagaagagcactctgaaaactggacgtcgggaattgatgaactggcatcgcaccccaacaacacactctgcttgtgggccttactctccagatacctgatgtattactggagaagcaaatgcaacaaggcaaagatgtcttcattttctgtcaaagcaaggcctcaactatggtgtcattgaggccctgaatctccgcagccagccagtcagaccccatcaacagctgcagcaagcagggctgaggaggggaatgggaggcgataggagccaatgagggctgagcccgcagctctgtgtctgactggagcagagagacagagaggccagggccagaggaaaccccagcagcaagggaaaaacagattgactctcagtgactcatttagctcctgggttggacagatctctcccctgctggcaatttggctctgcatcaatagttcgaataccaggctgaacagcttcaaataattagggggaaaaatctgcaaaactgctagccatccaattctttactctgtgctgaaagacacagtacaaatgacatctaggttattaaatatgaagtcactggatttgctgcccatttggtccaaaggcagaaaactggataaaactcaaatttataattcagtgtagatggcctgtttgtccttgaggcgatccatgaattttggctgggcaggcgctgtgaatgtggaagtaatgtcgtgggggaagggggatgaacaaggtttgttccccccgccccgccccgactcggcttacaccccctggggaaaaaaaaatgaaaatgtcaataaagactgtgaatgtgaagagaaatggaatctgagcccagagtttagtagctggcagtttaaactttatatactttaggccgacaggcgtctggatctcctgtactttatatccagcgtacaaaaactgaagcaacaggctcatttggtatcagtaaaggtcagttaaaattatagagacattttttggagcaaatctccagtcttgtatttgcatatttatgaactagagattaagataggccattccacttattagagcagtgctgctatagttaatagtctgtcagcatttccattataaaccccatttttcagtgtttagtatctcagctgttagaaattacatcaggctgaaaagtggtcttcagcatctcaggccttggcagggtgagccggtggtggtggtggtgatggggcttgggaaaccaacaaagacatttaaatcaagccaactgtttttacattggatattaacagtaaatatgaaatcagagattttgaggggagttggtgaattcttctcctccctcaacacccccccaccaaattatctttcccctgtcttatccttgtcagtatcagggctttcactctctatttaaagggaagactctgggattttagggcaaagatccaaagttttggcttggcaaaatagttttcctcacttcactggaattgtgggggtaggggagagcatcagagtaaagcaaagatgttgaagacattcattcattcattcattcataaagaattggctcatgcaatcatggaggctggtaagtccaaaatctgcaggttaggtgggcaggctggagactcagggaagagctgatgttgcagtttgagtccaaaggcagtctgctggcagaatttcctcttcctcagtggagatcagccttttccttatgaccttcaactgattggatgaggtccattcacattatggcacataaaattaaccatcacagaggctaagctgctttactcagtctatgatttaaatgttaatctcttctaaaaaatacctttgcagcaatatccagacatctttgaccaaatatctgggtaccagggcctagccaagtcgcacataaaattaaccattgcagggaccatgttttaaagatctcctatacatcaaatcctgggcttggccttggagacacaaaattaatgacacactccttgtcctcaagaaacttatgatctaccatcacactggtaccaagttttcacaataaaattacagactcaatagctggttccatgctttgctttctctttttggccacttgggatatcccctgcacagaggcacaattgtgagtgtgcttagctgcattctcaagagaaggcactgctatctagggactccttatcacataggaagacagcctgctctttccaaaccaaattcttgtaaattcactggacactaacctgtcaagtaactcagtgatattcaaagatcctttgggatttgaggagaaattggaaaaagagaaaagaggaagcagcttgctttctcaagtcattcattcaaaaaaaaaatgagtattggctcctgttatatggctcctcgatgtgttttagaaaccacacaaacacatcctcaactggacaaccatagagcaggttgaaaaattcctactctacctggcggagtttccagcccctctgcagaagtgcacacctatgcaaaaaccttcatcagaagagaaccttaagggatagtctgacagtagggaatcccaatgtgtataaccagtggtccttgctatctgactccgagagctacactgagtaatagaagcaactctccttgccctgtcttctaggtttctattatacttggagtaggtaagctttattttatttgctcaagatatgtcacacccctggacacacagaataaaaattcaaagtcctcctggaattcaagatgtgtcatacccctggacacacagaataaaaattcaaagtccgactagagaggcagagaatatcatcactgtatcactccattttactttattgaaaaccttaaaagtaaatataaaacgacaaattacggtgctgctattgttgcttgctgtctgggaaaaaaagaaatgttggataagaaggtcaaaatgtgccaattcaatgccctgagaatggtcacctaatcttctatcaagagatgtgacataccatctaaagaacggctgcccagccaggcgcagttggtcacatctgtaatcccaggactttggaaggctgaggcaggcagattccttgaactcaggagttcaagaccagactgggcaacatggtaaaaccccatctttaccaacaatacaaaaaaaaaaaaaaagctgggcatggtggtgcgtgcctgtggccccagctacttgggaggctgaggtgggaggatcacctgagccccaagggtggaggttgcagtgacctgagattgcaccattgcactttagcctgggtgacagagtgagaccctgtctcaaaaataagtagagaaagaatgactgccctcaatgcctaggagcttgactctgctttacttctgccctttcgattctctgtgaaatgaacaggacttatgtaattgctttcagcagcatctttgaattacaattacataataagacacacaccaggatgtgtgtaattgtgtaataacagcatgcctcactgtgctaggttggtggccaataaccacttagtcatgctattatattataagaacatatgccctcaaggcatgttgaaattattctggggatctctaaaggaaagctgactgatcaaaagagagccccaacttaaaaagctataaaataaataatttttaaaaatctgatagtaatcccaacaagaaacaaaaaaattacacctaccctaaaaacaaacaaacaaaaaacctgtagtgtaaaatcaaaatcaaagtgttgtgtaatgattcacttacgtcaccacaggatttaagatgacagagtgttaataaggaaaaaacaagaagctggccagaagtcaggtgtcgtgatgccctcttcatagttggtcagcgtgaagactacagaggagttatgtctcaacccagaaagttctagcttctttggagcctactcattcccaagaaaatgacaccccaaaggctctataaactttccacactttgaacttttgtgttgttctcatagtcatcagatcaaaaaataatctcagaaatgtgagatcagacttttgcagttgaatctccccaatgatattttccttacagtgaaagtatgtgctaggataaattgcccacactttattcttacagcacaagatacatatatgttatatatatagtatgtgtacatacgtttcaatacctaatttttctgtatatgcaaactacatttccatctcttccactcttctaactcatttggcaggaaaaaaacctcatgcaacaaaaataaggcagtatgagatgaggggagaggtgggagagatacttttgcaatttataaaatattagtttgtcacttcttagataaggctgtatcaatacaagttataatatcgaggtaaacataaatgtatatgtgtaatatacttgtaattcacaattgatgttttgttttttccttatgcaattagaaccttaaaatatagaagttttgatcattactgtaatgggctgaattatatctcccctctcccctagattcatatgttgaagtcctaacgcccagtgcctgagaatataactgtatgaggagataaagtctttaaagaagtaataaattaagaggaggttattcaggtgggccctaatccaatatgactggtgatatggtttggctgtatatccacccaaatctcatcttgaattgtagctcccataattcccacatgttgtgggagggacctggtgagagataattgaattatggaggtggtttacctcataccattcttttttgttttgttttgtttttttgagatggagtctcactctgcctcccaggctggactgcagtggtgcaatcttagctggctgcaacctccacctcccgggttcaagcaattctcctgcctcagcctcccaagtagcagggattacatgcacgtgccaccacacccaggtaatttttgtgtttttgtagagatggagttccactatgttggccaggctggtcttgaactcctgacctcaagtgatccacacgtctctacctcccaaaatgttgggattataggcatgaaccaccatgcctggccctcatactgttcttgtggtagtgaataagtctcacaggatttgatagttttataaggggaaaccccttttgcttggctctcattatcttctcttgcctgctgccatccatgtaagacatgactttgctcttccttgcgctctgacatgatttgaggcctccccagccatgtggaactgtgagtccattgaacctctttcctttataaattacccagtctcaggtatgtcgttattagcagtgtgagaacagactaatacaactgatgtccttataagaagaggaaatttggacacaaacatgtacaaagggaagactgtgaagacccaggtggaagatggccatccacaagccaaggggaaatgccccagaggaaaccaaacctgcagacaccttgatcttggacttctagcctccaaagttgtgaggaaataaatgttgtttaagccacctagtctgtcgtagtttgttatggcagtatacatttattacattattatatcaactgcacatttattacatcaacaaacttttttttaaacaatgctgagtataagtaatgagaatataatggagaggaaaacaaggtccatgttgttttagggcttatagtccaccaaaaaataattttgacaggacatgcataggaaaggcagcaaatatagttgtgggttttaatccattacgtatgtggcatttccaaaataccatatgtaagctgattttaaatattttcagtgatcttaaaggacatcaactgagtatttcagtcaccttaacaaccaaaagtattcaatgattcaacaaatgacctgcaactaatgactcaatctaaacccaatctaaacctccattgagttaaatttgaggaagtacctacaaaattattgttacctctctgcagggtgctggactggctctcacccacttcaattatgcacatctcttcccaacttcatgttcagtcataccagatgagttgtttgaaatcagcacccttcacactgcccactgaaggctccacttcaagtctgccctcctctggagccttttgttaaatctttgccagcacaccattcgtcagggtgcacccccatcaacaagacagcttaaagacatttagaaagcaaaaccatgacagaaaatgtcaaaggggaagagaggaatatacaaatatggaaataaaataataaagtggaagattctgatgtattaagccagagcagcagttctcaaatgttatggcctatatccaaatcacccagagatgtagggtggggccagggaattgaatttctaacaagtttcctggctatcccactgcactggaccatcggtatggctttttctcctaacaccagttcgtctcctgtgcttaccacctggttgaggaggggtggaagtgcatggcaggtgtggctaatgccattggattggcagctcttggtaaaggaaatcgatggccatgtataaacaatgtttaagctgaagtccagtgaaatggtccctggggacccacaagctgctcacagccaggaaggcagcactgcccaatgttgcccccaccatggaagaaaaagcatgccaaacaccttcatctagccctgaaggtattttcactaggcctatgtagaaggtagtttggctaaaacagcttcagttggcatatgcagaaagacacaatcttagagccacagtgaattatttgtttggaaggcaggaccctattaagacactggatgttgccttatccatatctggatcaccacaatgcaaaccatgcccctggagacagaaatctacaagccacaaagacagggagaaagctaacatgacattactgggaaggtgagtatacactaattagatctcacaaaataaggatgatagaagaattccattgtgttcacatttcttaccctctgtaatgttgaagatctgaaatttggttgtaaatacattggtaacttttttgtccaaattacattcccaagaaacagataaaaactgaacacaggttgaagtttggctgttttataagtatgcagttactgaaagcactggtgataacactgtcagaagtgaaaaattatagatgattaataagaaattgttgaaagaaatggttcttgccaaacaaaacatcaatgagattgaaaacaattttcattgacaaaacatgtgcctgttgggcattccagaggagtgtgatgagaataaatttgactgaacctttaaaagagtttttacttgttgggtcagatctttctgctaaatccctcagtgtcaaaatgctgttttgcctttcctacctgctctgggcatactccgtcacaaactacgttgtgtgaatctgaggactgctttagaaatgagttcccaaattgctcaagaaatagttcaggctgtaattctgaaaagccttctgctcactcaggtcctgtggggggagtttagccaataaaggaaagaaagaaagaaagaaagaaagaaattaaactctttcaaaagcaaactttggaaccatgacaaacatggaagccatgtgtataccatgctgtcagcatttcctgaagaagctgtgtgtgggcttcagggagggctctgggatgataatctggaaatgatgaagaattcttttatgtattttattgtagtacaggtctaataaaagctaagtattataaatgttaatggtgcattaattgtaagttaaaacaataatttgatactatttttccaaccacaaattggcaaaaaaatttaaaagtgagaacatagggtttggtaatgaaataggaaaatgggtgaacactcaaatacagtttgtggaaatataaattgatagaacctttttcagggacaacttggcagtatctatcaagattccaaatatacctatcctatgaggaagcagaatgcatatgagttaaggacagactctggattcagagatcctggattccaatcctggctctaccaattagaaccatgagatctcaaacaagttgcttaacctctctgagcctaagtttatcatctgcaaaactgagataataatagtatctataactcatggggttgtcatgggaattttaaaagttgatatttgtaaagtgtttacactggtgcctagcatataggaagtgcctagaaccctaattcaaggaaaacattctataaaacttctagccaaatgtctaagttcaatacaacatggtttctcacaacatataaatggaaactaactctagaggtccaacactgagaaaatatgcaaataaatgctagttcatcagcgtgattgaatagtttatagccctttaaagaatgaggtaggctgggcgcggtggctcatgcctgtaatcccaacactttgtgaggccgaggcgggcggatcatgaggtcaggagattgagaccatcctggctaacacggtgaaaccctgtctctactaaaaaatagaaaaaattagccgggtgtggtggagggcgtctgtagtcccagctacttgtgaggctgaggtgaggcaggagaatggcgtgaacctgggaggcagagcttgcagtgagccaagactgtgccactgcactccagcctgggtgacaaagtgagactccgtctcaaaaaaaaaaaaaaaaaaagagtgaggtacagctctgtgtaccccaagaacaacatattgctgagtacaaaaacaaattgtaaaacagcatgttcagtagaatctcattattataaaagtgaagtttgtgtgtgtgtgtgtgtgtgtatgtgtacctgaaaagatatataccatacttaccagtgatcacctctgaggagtgagattagagcagcgaagagactttcaattcttactttatacacttctgtattgtttgaacctttgaaaatgaacttaaattactttttaattaaaaaagcttttaaatcactagtctgagcatagtttagatttaaataattattctttctctctctttttttttttaaagattcagattcatagccatgcgatgaatgctactgttatcattgacatagatgaccagcccggaaataagattgtatgaatagtccatttagttaaatgtttcggccacttagatctatgtgaatgtgagcataaaatgtggaaacacttaggaaataagctttcattgtatagtataatagggggtaatgagattcggtcaatctgtcagagatttaaacctacccgatcctaaagaaaaacaggcctaaaatatttcaaatgtgaggttatattaaaagccacagtttcaaactgtgaagctaaagaaatcagttgtttcagtttattgtctcagggaaagcacagtgtaatacctgaaggacttgaaagagaaccaaaaggaggggtagcattcccagcagctagcactttcatccaatgccagggctttcattggccaaattattttcaaagatactgcctgaccgaagcacttctgcaataaaagtatctctgtgttagtcaatggaatgggggaatgttaaaattgaaagaggcctttgagaccagctaggtcagtgtccacatttcatagaagaggacactgagttctggaaagatcacgggacttcgtaacaaaaacaaactacagctcaggtcaactgaccatcagtatagtatgccttctaatacactactgtcctcgcactttttgtattttaacgtaatggttttaaaatgcacatgggaaaaataaatataaactataatatagaatacaaaagctcccagagaagagtttacttcctattcttgtactccaagtcccagttactctcctcagatatgaccactgtgctcctcagatatgaccactgtgctttttgttttgttttggttttggtttttgagacgagtttcactctgttgcctaggctggagtgcagtggtgtgatcgtggctcactgcagcctcaacttcctggactcaagcgatcctcccaggtcagcctcctgcatagttgggagtacaggtgtgcaccactatgcccagctaattttttgtatatttttgtagagacaggatttcaccatgttgcccaggctggtcttgaactcctgggctcaagtgatctacccacttcggcctcccgaagtgctgggattatacctgtgagccactgtgcccagcctataactactgtcagcagttcctctgatagtctttcagagatgctctatgaacttctaagcaagtgtatatatgtgtgcatgcatgtgtgcagcatattatatatacagttgacccttgaacaacatgggtttgaactatgtgggtccacctatacatggattcttttccacctctgccacccacaagacaacaagaccaacccctcctcttcctcctcctcctcagcctattcaatgtaaagatgatgaggatgaaaacctttatgatgatccacttccacttaatgaatagtaaatgtattttctcttcgttatggtttcttaataacatgttaacttactttaagaatattgtatataacacatataacacacaaaatatgtatgtgttaattgaccgtgtatgttatcagtaaggcttccaatccacagtaggctattgatttttaagttctgagggagtcaaaagtcatatgcaaatttgcaactgtgttgagggggtaggtgcccctaacgaccaattgttcaagggtcaactgtcctatcaagcttcttgtttatttctttgttttcacttgaatatatcatgcaaattattccttatcaatacatgttaatcttctctcattctttttaatggccgcacattatttcattacattatattacaatttatttcatcagtcccatctcaatagatatttagacctttttgtcttttgtattacaaacatgctgttatcaataaaaagtactcatatacacatctttaagcacctgtccaagtatgtgtggagtatacatcagataaattattagatgtggaatttagccaaagagtatatttaattttgataagcaatgccaaatttttctccaaaaaggtatattaatttacacttctacaaagaaaatatagtcattatttaagttttatttgtgatttttttcttcacttattaaatgataagttccttgaagaaagaaaccatagcttctacaacttgattccaatgcccatggccacacatatcatcattctttaacaaagattgaatgaccaaaactgtgctaaagactgaaatacaaaaatagatatatattatttcctatagtggtagactagttatctcagagtaacccctctgctgagaaaaagtaaaatgaaattgggaaatatattttttgaaaacccacaccttccaaaagcaccaaatagttaatcgaataagaaactgcccagtcaaaagctagaaaaaatgaagcccctatattaaaatctgtttggccctaatgagatttgcttatctcgaagaaataactgtgaaactgcatttgcttagggcaggtgggggtctttcagggcagaggaaacaagacttaaagctcagggtccaccttagcttaagactcagataaaccacctgccactgtaaggtagaacctagcaaggttatcacttcagggtaagggtaaaccagaattaaaccagtccttcaaaagacttgcagcctagcttctcatcatttggctcttttagggaacctgaagcctcgaacttagattaagatagtcctgcattagtagcatctctagaatcatggcagaaacaaattaaaatactctcttgtaagaggcactatcatcttatgtctcaaagtattcctaaaatacattgaatagcacacaaagaaaacaaaatgcataggaaacaaggtaccatgagcaagaaccagttaaaacaagaagatagtagaaacagaccaacaaagactgtttgtcatatattgggattattagataccaactataaaacaactatgcctaccaagccttaaaaaagaaaaaaaaaaaggaaaagaaagaaagaaaagaaaagcttcaaaatttcagaaagacactgagggggaaaagtgacataattttgaaaaggggaaatataatgacaaattatgaattaattgagtgagtttaagggcatattagacatagctgaagaaagaattattgaacagaaaaataagtcagaataaactttccatattacagcacaaagagacaaaaacagaaaatatagcagagaggataagagagagggaggacatcttgaaaaagtctaacatatatttaattgcagttttacaagagagagaaatggagcaaaggcaatatttaaatttttatggttaaatgactgagaattttggaggactgactcatagaacttaagaattccatgcaggataaagaaaaaagaaatctacaccaagattcaccctgagatattgcagaaaacaaaagaaaaagtgaaaaaatctttatagcgtccagaaaaaaaaattttaatttaagtttctaaagcacaaaaataaaaaccaaaggaaaaatgggaatatattctccatgttcttatagaaaataaaaactattatagaactttatagccagcaaaatattcttcaaccatgaaagtaaaatacaggcattttcagacaaacaagaattgagagaattcacaaccaactgacttaggctaaagggtcagagacacagaaaggattaagaattttaaaaatggtaaatatatgggtaaacataaatattgaccttaaaagctgtaatatgcatgtcttacagagtgttaaaatatacagaattaaaatgtatagcaactccatgttgccagctagaaactagggagaaagggaagttttgttaaattattctaaggtcctgacctcttgacttcaggtaatccacccacctcacccccatctctactaaaaatacaaaaattagctgggtgtggtggtgcacacctgtaatcccagctactcgggaagctgaggcaggagaatcgcttgaacctagtaggtggaggttgccatgagccgagatagcaccattgcactccagcctgggggataagagcaaatctccatcacaaaaaaaaaaaaaaaaaaaaaaaaattattctaaggtccttatactcattccagaaggacagtaaatgtactgattaacattagactttaggccaggcatggtagctcacacctgtaaacccagcactttgggaggccagggttcaggaggattgcttgagcctagaagtctgagaccagcctgggcaatatagcgagacctcgttgctacaaaaaataaacaaacaaaactagccaggtgtggtggtatgtgcctgtagtcgcagctactggggaggctgaggtaggaggatcgtttaagctggggaagttgaggatgtagtgagctgtgactgcatcactgcaccccagtctgggccacaaagtgagaccctgtctttaaattaaaaagaaaaaaaagactttgctaaggaaagggtgactattgtgtgatttctagagccagagagccactgctcaaagaatagaaaaagagtacattattttcatatcaacagaaaaggaaaaaaatagatggtaagaaaaaataatcatttcaaaagaaaggcaagaaaggtgagaaaaagaaacatagatctggtggaccaaacaaaagcacaaaataagatggttgtttcttggccaggtgtggtggctcacgcctgtaatcccagcactctgggaggcccaggtgagcagatcacttgaggccaggagttcaagaccatcatggccaacacagggaaaccctgtctctactaaaaatacaaaaaattagctgcagctgggcacagtgggaggccaaggcaggcagatcacttgaggtcaggtgttcaagaccaacctggccaacatggtgaaaccccatctctactgggtcgtgttcattcttactctctgtcccactcaatatctcctcctggagcccctggggctgccaggtgcttatctgtcaggcgatgcccccagctgaggaataagggacccatgtcctcaggaggaaggagggtcacttgaggtaacgagcactttctgggtccgtggagaggacacatggaagacgctcagtgagtgtcgggggatgcgtagtccctgacacgtgccctgataacttcgagtatttaaactgatttcttcccactgatgtctcttttgcttctccatggattcccacatccccagtcaggactcacccacctggctccaacgctctcacctgctggctttcccaggagtccagagcactaaccaggctccaggcaggaggaaagaatgaatgccttttgtttcattctctagtgacttctccctgctgtctactagggcatttgtttctcaccatgtcttctctctctcaatagtcttatttttccaaaattttttccaatttcaatgggctagattgtaatgttagtgattataatgttaattcaacaccttccacatccctatgtaataatttcttccaatagatttttatatataaatatatgcatttatgtcactgttatatacgttatgcatatttgcatgtatttttaataaaatgtagatatatgcaatgtacctatctgtatgatcatttcatcaatatcccatgtttagtcttcccaattcttttctctcatatgttcatttaacgttgattttgcttgatttttagaatctcctccctcccaaaacacagcctgtatccagtgtgatttccttgcctttgccttatctacttggaagctatttgggtttattaatcctaaattttttgaatatgtttgccagttgggatcaccttttcctcctggcaatcttgtcattactgggtgatgcatgaaaaatcaacaatacagaaagtacccaaatgtctttcttggcttccctttaccccttggattttcttgttcaaggccgctttccttctctgatgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatctatccttttacttttttaaccacttccttatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctacagaagttccttttatgcattgggggaaaaacatgttggcttttctcttgacgtgggaggtgagtacgtttctatgaaggtgataaggatccactgagtcttccatataaagatcatattcctgctccaagtggccattactgagctgagagatgtcattgccgcagtgaggacctataggcacatgtaggttgaatgaaactctagttctacctggaagcccagacatgggatgggtcagtgagcatggctctcttcctagtctcaggccatgcctgtggcactctgattctactctcatgacattggacctgggcagatgtgacaaattcagagaactatgattttgactcaagggtttgtagatttcctttttcactctaatttcagtgtctggagtcctcacaaccatgaacaatctgagtatttgatgagacagggctaaatattgcagtttttctcctagaaatcatttgagggtatttgctttaaattgattggaaaaataaggcataactgtttgcacaaacttgggacaaatgatattgggataacgatctactagaatagggacattttacccagagtttctgggagaaaaaccgaggaatttctatcacgaccagccttcaggcctcctgaaatatatctctcacagtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaagaaaagaagaaggggaagaaaagaaggggaagaagatcaaaacccaccatgccccaggtaactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttagtaacgtaccataggttgaccatacttcaaaagctgtactctcatggccactgcatcgaattttgagcatattttatggaaaactattgagctcactcttttcatgatcacagtttgctgtgtgtcatgagggcactaactcagagtgtcctttgactcccttaccagtatgtcacctggccaattcactagctcactttctctctgtctctatctctgtctctgtctctgtctctgtctctctctctctgtctttctctttcattgttttctacctggccctgttctatcccaacataaaggcaataatttgttacctcattaatggatctgtcctttttcttttctaaccacttccttatgttagccatgaaatctagctggggctgtgtggtttctgattccccctggcttattctttactttttcccactttccaggctcagcagggagctgctggctgagaaagagcctgaagtcttgcaggactcactggatagatggtattcgactccttcagtttatcttggactgactgacccatgccagccctacagaagtgccttttacgtattggagcaacagcgtgttggcttggctgttgacatggatggtgagtacctttctatgaaggtgataaggatccactgagtcttctggttagggtcatattcctactgcaagtggcccttactgagctgagagatgtcattgccacagggaggacctataggcacatgtaggttgagtgaaactctagttccacttggaagcccagacaagggatgggtcagtgagcaaggctctcttcctagtctcaggccctgcctgtggcaccctaatcctactctcaagatgttggatctgggcagatgtgacaaattcacacaactctgattttgtctgaattctgtagatcttgtagatttcatccttcactctaatttcagcgtctaaaatcctcgctaccatgaacaatctgagtatttgatgagacagggctgaatagtgcagtttttctcctagcaaccatttgggggcacttgctttaaatcgattggaaaaatatggcataaccatttgcacaaacttgggagaaatgatattgggataacgatctaccagaatagggaagtttacccagagtttctgggacaaaaaccaaggaatctctatcatgatcagccttcaggcctcctgaagaatatctctcacagtgtcctattctcatgctgaggagcctgaagtccctgtgtgaggattagacagtggattgttatgtgtgtaggagaaccagcttcatatgtctgtccatgtctgaacttattgcagaaattgaaaagtaccaagaagtggaagaagaccaagacccatcatgccccaggtaactttgagcaattatggatgcttaattctgtgttgacacctggagatgccaggtccagggaaaacaagagtgtgttcaatttcatgttttccacgaaggttgaattactcctactgccattgctgttggttttcattgcagtagatgtttaggtttccatttcttcctccccttgtcatttactaacttactataggttgaccatacctcaaaggccgtatggcaactgcatggaatcttgagcaagtttatggaaaattattgagcccactgttttcatgatcactgttcactgtgtgtcccgagggcactaaatcagagtgtcctttgaccccttcatcagtgtgtcacccggccaattcgctgagctcactttctcctctctctctctctccctctccctgtcttctctttcattcttttctacctggccctggtctatcccaacataaaggcaataattcattacctcattaatggatctgtcctttttctttttaaacagttccttatgttagccatgaaatctagctggggctgtgtggtttctgattccccctggcttattctttactttttcctacttttccaggctcagcagggagctgctggctgagaaagagcctgaagtcttgcaggactcactggatagatgttattcgactccttcaggttatcttgaactgcctgacttaggccagccctacagaagtgctgtttactcattggaggaacagtaccttggcttggctcttgacgtggacagtgagtaccttactatgaaggtgataagcctccacctggccttccagataggggtgatattcctgttccaagtggcccttactgacccgagagacgtcattgccacaggcaggacctatgggtgcatataggttgtaatgaaactgtagtctcatctggaagcctagacatgaaatgggtcagtgagcaaggctctattcctagtctccagccatgcctgtggcaacctgagcccactctcagcacattggacccaggcagatgtaaaaaattcacagaactatgatttggactcaagggtttgtagatttcctccttcattctaatttcagtgtctaaaattcttgcatccgtgaacgagctgggcatttgatgagacagggccgaatactgcagttttcctcctagaaatcctctggggcattttctttgaactgatgggaacaataaggcataactgtttgcacaaacttgggataaatgattttgggataacgatctaccagaatagggatatttcacccttggttctgagatgcaaaccaaagaatatcatgaccagctttcaggcctcctgaagtatatccctcaaattgtcctgttctcatgctgaggagcctgagatccctgtgtggggattagacagtggactgttatgggtgtaggtgaattggcttattttgtctgtccctgcctgaatgtattgcaggaattaaaaaggaccaagaagaggaagaagaccaaggcccaccatgccccaggtaactgagcaattgtgaacagctacttctgtgttgacatctggagactcctggttcagggaaaatagagcgggccgacattatcgattacatcttttcaaccaagcctgaattattcctactaacattgctgttggttttcattgcagtagatatttaggtttccatttcttcctccccttatcatttactaacctactgcaggtggaccagacttcaaaaactgtattctcatggtgactgcatggaaacttgagcacattttatggaaaattattgagcacagtcttcatgatcactgtatgctgtgtgtcctgagggcactaactcagagtgtcctgttactccctcatcagtgtgtcacctggacaattcactgagctcgttttctctctctctctctctctttctctctcagtgtgtgcgtgtgtctttgtgtgtgtgtttgtgtgtgtgtgtgtgtgtgtgtgtgtctgtctttctctttcattcttttccatttggccctgttctgtcccaacatgaaggcaataatttgttacctcattaatggatctatccttttacttttttaaccacttccttatgctacccatgaaacctagttggggctctgttgtgtctgatttcccctggcttattctttactttttcctccttttccaggctcagcagggagctgctggaggtagtagagcctgaagtcttgcaggactcactggatagatgttattcaactccttccagttgtcttgaacagcctgactcctgccagccctacagaagttccttttatgcattggaggaaaaacatgttggcttttctcttgacgtgggaggtgagtacgtttctatgaaggtgataaggatccactgagtcttccatataaagatcatattcctgctccaagtggccattactgagctgagagatgtcattgccgcagtgaggacctataggcacatgtaggttgaatgaaactctagttctacctggaagcccagacatgggatgggtcagtgagcatggctctcttcctagtctcaggccatgcctgtggcactctgattctactctcatgacattggacctgggcagatgtgacaaattcagagaactatgattttgactcaagggtttgtagatttcctttttcactctaatttcagtgtctggagtcctcacaaccatgaacaatctgagtatttgatgagacagggctaaatattgcagtttttctcctagaaatcatttgagggtatttgctttaaattgattggaaaaataaggcataactgtttgcacaaacttgggacaaatgatattgggataacgatctactagaatagggacattttacccagagtttctgggagaaaaaccgaggaatttctatcacgaccagccttcaggcctcctgaaatatatctctcacagtgtcctattcttatgctgaggagcctgaggtccctgtgtgaggattagacagtggattgttatgtgtgtaggggaatcagcttaatgtgtctgtccatgtctgaatttattgcagaaattgaaaagaaggggaaggggaagaaaagaaggggaagaagatcaaagaagaaaagaagaaggggaagaaaagaaggggaagaagatcaaaacccaccatgccccaggtaactttcagcaattgtggatgcttaattctgtgttaacacctggaggcaacagattcagggaaaccagagtgtgtttgatgtcatgttttcaacgaaggctgaattactcctactgtcattgctgttggttttcattgcagtagatgtttaggtttccatttcttcctccccttatcatttagtaacgtaccataggttgaccatacttcaaaagctgtactctcatggccactgcatcgaattttgagcatattttatggaaaactattgagctcactcttttcatgatcacagtttgctgtgtgtcatgagggcactaactcagagtgtcctttgactcccttaccagtatgtcacctggccaattcactagctcactttctctctgtctctgtctctgtctctgtctctgtctctgtctctctctctctgtctttctctttcattgttttctacctggccctgttctatcccaacataaaggcaataatttgttacctcattaatggatctgtcctttttcttttgtaaccacttccttatgttacttctgaaatctagtgaggctctgtggtgtctgactttccctggctgcttctttagttttgtctccttttccaggctcaacagcgtgctgatggaagtggaagagcctgaagtcttgcaggactcactggatagatgttattcgactccatcaatgtactttgaactacctgactcattccagcactacagaagtgtgttttactcatttgaggaacagcacatcacctttgcccttgacatggacaatagcttttttactttgacggtgacaagtctccacctggtcttccagatgggagtcatattcccacaataagcagcccttactaagccgagaggtgtcattcctgcaggcaggacctataggcacctgaagatttgaatgaaactatagttccatttggaagcccagacataggatgggtcagtgggcatggctctattcctattctcagagcatgccagtggcaacctgtgctcagtctgaagacaatggacccacgttaggtgtgacacgttcacataactgtgcagcacatgccgggagtgatcagccggacattttaatttgaaccatgtatctctgggtagctacaaaattcctcagggatttcattttgcaggcatgtctctgagcttctatacctactcaaggtcagtgtcatctttgtgtttagttcatccaaaggtgttaccctggtttcaatgaacctaacctcattatttgtgtcttcagtgttggcttgttttagctgatccatctgtaacacaggagggatccttggctgaggattgtatttcagaaccaccaactgctcttgacaattgttaacccgctaggctcctttggttagagaagccacagtccttcagcctccaattggtgtcagtacttaggaagaccacagctagatggacaaacagcattgggaggccttagccctgctcctctcaattccatcctgtagagaacaggagtcaggagccgctggcaggagacagcatgtcacccaggactctgccggtgcagaatatgagcaatgccatgttcttgcagaaaacgcttagcctgagtttcataggaggtaatcaccagacaactgcagaatgtagaacactgagcaggacaactgacctgtctccttcacatagtccatatcaccacaaatcacacaacaaaaaggagaagagatattttgggttgaaaaaaagtaaaaagataattagctgcatttctttagttattttgaaccccaaatatttcctcatctttttgttgttgtcattgatggtggtgacatggacttgtttatagaggacaggtcagctctctggctcaatgatctacattctgaagttgtctgaaaatgtcttcatgattaaattcagcctaaactttttgctgggaacactgcagagacaatgctgtgagtttccaacctcagcccatctgcgggcagagaaggtctagtttgtccatcaccattatgatatcaggactggttacttggttaaggaggggtctaggagatctgtcccttttagagacaccttacttataatgaagtacttgggaaagcggttttcaagagtataaatatcctgtattctaatgatcatcctctaaacattttatcatttattaatcctccctgcctgtgtctattattatatacatatctctacgctgcaaattttgggtctcaatttttactgtgcctttgtttttactagtgtctgctgttgcaaaaagaagaaaacattctctgcctgagttttaatttttgtccaaagttaattttaatctatacaattaaaaccttttgcctatcactctggacttttggattgttttttacattcagtgttataatatttgattatgctgattggttttggtgggtactgatgtgaattaataaaaacatttcatttccatgtttattttctaatctcttccacattgtaggctatgtttaccatacgtagcagaatgtatttacatttcttggttctagtcatttgtattcttcgtgagtgtgtgtgtgtgtgtgtctgtgtgtgtgtctgtgtgtgcctttggcatttaggaagggttgtatagctcatgttaaatattgcactaaaaatgtttttgatggttttcctccctttgaactagacacacttctaatatttggtttatagttttaaattataactttcagcatcaaatatttccatacaacagtcaattacatgatgtgttttctttttcctacctcctttacctgccacttctcataatagtatttgaacctaaacatataccggtgacattctgtgattatcatcctgcccctaccttggtttttatccattgtggtttagatccataatgaaatatattaacgctcatgagctattcaaaagtgaatgtcacagtcatcacttgctgagtggtactcatccttaacagagtcctcatgagggaatcaggtctcgctgagtttagcatgtttaataatcttttctcacggtctcgatacatggatcacattactagatataaggtgcttgtccaaaatgatttttctggagcttttaggagatattgtcatccttgggggacatacatggtgtatgttctcattgtgggattctattttgttctaccaggacctctaatttctgccagttacttcattcatttgttctcttcaccatgagtctccagaggatacttccatggtccgtgcctccccatctcccagcaattctgcatttccaagattggcacctctggtcctctgcacggtgaagccccttcctttcaattccccagtagccagtgctctaatccaccaggtctcaggcatgatctatgtttctccacactcgctttctgaggagagttttgcctgggttctatcatgaacaggccctccctgctgtcctggcctctatttgcatagtgtttcctgctccctctgccgtcgtgtggctcccagacctggctaaagaaaatcacctgagggccacagtgttccctagccctggtgtttagggcaggattatgggtgagatttttgagtctctaagttgacccctacggctctgaagtgtaagttgagaaattcagctgttatcatcctaggtggacttgctccctcctatcctcctacttcaaatgcagaacttcaatcgtttacaaaagaagactgaatcgtataatagaacacacccttattcattggctggcttcaccaatcatctcatggctgaacttgtaaaaatacaatcttagccacgtacctatgaaatgtatgtgtgtgtatatatatatacatgaatttgcttctgagattatggaggctgaaattcccaagatggaaggaaagctggatatccaggaaagcatttgtttcccattaggcctcttaattctctcctggcccttgattgattgcatgaggcccacccctattaaggagggcaatctgcttcacttagtctgcccatcccaatgttaatcgtatctgaaagactctctggaacacaaccagaatcatgtttggccaaatgtcctggcaccctggtgctcggtcacagtgacaactacaagtaactatcacacatgccctttgtcatattggtgatttccactgtttttctcccaaactgcagcttatatttgttctcttaatactgttgagcaaaaacttttaatttttataaagtcgaatttatcaatgttttctttaatggtttgtgtttattgataataaagaacactttgcctaactctgtgtcatgaagattttgtcttatattttctgctatactttttctagttttatagtttatatttagttgcataatccattttgagttagtttttgagttagtattgaggttcaggtgaatttttttcctttgggtataaaaaaaacaaattgtgtaaaaaaagttgtttctacacaatttgttgacaagagaatgccttctccactgaatcatatttgcacctttgtcaatccattgggtggttgagactggtgagaggactgtcctggtgtttggacagagagacagggcatgaagtagggtggttcttatgggaaaaattaaggaagacacatttttgcatgaggaataggaaatccccaagcacaattgggggtaccctctaccagcatgttgtagcacactcatctgtgctctacctgtcctgctgcaaaagcttgggtgtgcatagacactgaggttgagtggtgtctttgggcattttgagcattgacaccaaagttccagcatcaaatcttagaatatcaagcagccagatggatcacctgaggtcaggagttcacgaccagcctgactaacatggtgaaaccccatctctactaaatacaaaaaaattagccaggcatgatggtgcatgcctgtaatctgagctacttgggaggctgagacaggagaatcgcttgtgtacctgggaggtggaggttgcagtgagctgagatcacaccattgcactccagcctgggcaacgagagcaaaactctatccccccgcaaaaaaaataaataaaaataaaagaatatcaagcagccaaagaagcaggaaaacatgacacataatgaagaatctaataatctagttgaaattgacagacatgttggaaatagaagaaaaggacattagagcagttagtataattgtattttaattaaatagggaggttgaagattttttaaatatcaaattctgtaaataaaaagtatgatttacagtctgaaatggaagaaggcagtggattaaacattgcagaagagaagattattgaactagaaggaatagaatttgaaactaacataaatgaaacacacagtaacaaatgacttgaaaacataaaaagaccatcggcatcaaaactttaaaccccccagtatagggctaaatggaatccctgaagggcgtgtagtggagaagagagaaaaagatatttaaaacatactggatgaaagatttagaagctccatggaaaccataaacttcaaatattacagaaatatgattattctaagaacaagaaacatgaagaaaacttcaccaaggaatgccttaatcaaatccatcaaaaccagtgataaaaaggaaatcctaaaaggaataaaaagggaaagaacatgttacatacagagcactaaatataatgatggcataagatttctcatacaaacaagaagtttgcaataaagaacttaaaaaaaagaaaaactgtcacctacaattctacacctggccaaattatcttttaaaaataaacatgagaaaaagtgtttttgaacagaaaacaaaatgatctcaatttgcagatggtgtgatcctatgcatagaaaatcccaaataatacctacagatgcaaacacacatacatgcacacagaggccagtcacacacacacacacacacacacactcacatacacacactactagagttaataagcgaattcagcaaactttcagcaaacaatcagttgtgttagcaatgaacaatctgagaagaaaattgacacaatgatttcatttataatagcactggtaagaataatatgcctgggaataaatttgttcaagaaggtgcagtacttgtacacagacaactacagaacattgctcgaggagattcaggaagacctaaatcaatggacagacatcttgtgtccatgggttggaagttgtaacatggttaagataaaaatacaactcaaagcaacccacagattcaatacaatcctatcaaaaagtggccttttttacaggaatgcctaacaagaacttcatattcctaaaaaatagtgtgtccccccaaaacaaaagcaatcttgaaatgcaagaagaaacattttctattccaaaggtctttaactgctctaagcagtacttggtagtcttcaatatataggctttcacatctctttttttcttcttttgtttctgcacaggatctcactctttcacccaggctggagtacagtggcacaatcacagctcactgcagcatggaattctcaggcctatgacatcctagggcctcatccactgattcctgggactacaggctcacaccaccaaacccggataatttttctgattttcagtagagatgagggctcactatgttgcctaggctagtttcaagcttatgagatcaagcaaccctcctgccacagccttccaaagtgctgggatttgaggccaagcctggctggctttcatgtcttttctatgtagtttatatttctggatgccattgagagtctggctggctttcacatatttgctatgtcgtttatatttcttgatgctattgtaaatgtttattaaaggaatcttttaaaaactttgttttggccaggcgcggtggtccatgcctgtaatcctaccactttgggaggccgaggtgggtggatcatgaggtcagaagatcgagaccatcctggctaacatggtgaaaccccatctctactaaaaatacaaaaaaaaaaaaattagcctggcgtggtggcgggcgcctgtagtcccagatacttgggaggctgaggcaggagaatggcgtgaacctgggaggtggagcttgcagtgagccaagatggtgccactgcactccagcctgggagacagagtgagactccgtctcaaaaaaaaaattgtattaaaattatatatttaaggaattacatatatatttatatatatatataatacatatccttaaattatatatatttaaggaatacaacctgaggactacatatacatatacataatgaactaatgcctactaggtgaggggctgccttgtgagcaaacccaaggtccttggcttatgaagcctttgtctagaaggatggagggatcagcaaggtgggcacacagcaggttctgtctttggtgtgggcttctgcccactcgggtctctggcaatactaatcaggcttcacgatgggtgaggtgagctaggaatgggaaagtggatgacttcagatccagagactgcagttgtcacctggggacctggcgtaggggtggaggagtctcccactgacttggccatgggtcaatgcccaaacatgcacaaggatgggactctcggcctcaatgctttaggagcccccagtcttctaaagagggtttgtggtggggaagaatgttcaacaaaacagaagagttatgggtgctctagcttggcaacggagaatacttccttgtgctactaaatggcaatatttgacaattacggatgacacaattgagcaacagctttcactgtttaacaagcagtgtctctggaacactaggttagtgctgtcggatgttgactgaaaagtcagtggtttgagcccatccagtcatattaatgtttctagctgacgtgaccttccatctgaagagtctcttccttggaccaaatatctcttaaagcttctcttcttcttgtctcttgtctattttctaaggtgcctctttgttgcttggggcaaaaaaagtccatttttaatccacacccaacaaacatctacccttacgtatcctggtttttagggttttgagtttgttgtttgttttctcagcttctcatatttggaatactggaaattcctaaagtggagaatgacagaacgtgaatcacagctatggtgaagccacaggctctggatgaaaaacctaatctgccagggtttgaagttaaacacattaatcttctgtgcctccatttctatctgtccaatgggctaaatcagaacacttaggttgtccagtgtttaaatgagcagtgcaggaaaagcatggagccaatgcctgtcacgtagtaattggacaacacgcatgagctcctatcagcgccatggtctccagcatttccatcaggttttgatctttgaaatgtccttcttgatatgaaaggatcattcctcaaacattctctaaccgatggccatgaaattgctccaatgtgtattattacaaatacaactgcagggaccagactgacacatgtatctgtcgtgcatcgcttgtctatttctccgtagacacctggagatggaattgtcagaccaaagtatttatacatgtttgattttgctaatttctgtctaaattactgtgaaaagaaaatataatatgtcatacttttaatattttttgagaattcttttttctccatcttctggtcaaaactgggaagtacttgcctaccatttcctctgaacttacttttgccaacatttgtgtagtcatacagtgggatcacattgtatgcaagacatcaaactcaaatccttaaatgaaagcgattaacatgactgtgtaaaaacttatcttcaaaatacaatgaatacatatatacacatacttatatgggaaaggaattatttggatactttatcaaagttatatatacttgaaaatttgtttagtaaaatagcagtgcccttgtgtactcccagagtttcatcacatagaagcaattatttcattatttatctccttatgcctaaatagatattattactttttgattttcaagtttaggcactacctctccttcacatacttgctcatcaccaccacccccaaacacgcctctcaccaccttacccttcaacacgtttgtgtcctcgtttgctgggtcaattgctacattgttataacttgtatattttattcagagttcagtcacattggatatacatagcaggaatgagaggccagtatcttcagggactctctctcaagtagataagcttcagagatttttgtagtctttggtcactctccccatctttttcctattccaggtaagtactggatctgatgggcccagctcaggtcaggcactctctccttgagcaggggagagcgggacatcttcatgtgcagtaccaggaagacactgtccaaagagggacaggtagttctaagacagaaaagtctgtctggggtacaggtaggcaaaacaaggacacacacacaaaaattagtctgttctgtgaggggagcatgcagtagagggtggattcagagtgggaggggagagttttgagagatatgggccatggatatcactctgtgggccggagccacacaagacggttggggtctctcaggggcagggagctgaggaggatctgccctccccaacctgggagactggtgaggggactgtcctggtcaccagacagaaatggggtctgggccagggcagttctggtgggaaagaaagaacaggacatctccttaaggaaaggtcctgagtcaggtcttggtagggagggaggttaccttgcccattggcagctgaagatggttggccagatgagggcactgaaatccatgtcctctaaacttgtagttcagtaaaagaacgacagcagtaaagggtctttaggaagaggaggtggaagacctgatttgggttgggggctccaagaagaatgtctgccttgctgtgcagaagcctgctacacaacctccctggtccccttgctcagtctcctggccagacccctgtgagccctggaagtgcacagtcagctcggccaaggcatctccagccaggactcatccctgggcatttctgtggccttgggtgccctggcctccaggccctgtcttgcaggcaatcatcctgcaagggaagggggaaaggaggctacttgacagttaactctgagtggctccacaaggtcctgacttagctcctagtcacttgcaaacctatatacccccatctcatcccccaaatgatgaaaagaaactttgcaggactcatgccagacaaatagggtgggaccattctgtagagccaagttctcaggacatcaataagagatggaaaccacctgctggaaggtgccacagtgggaaccttggggtcagggagcagtcactgaactgtcagggtgaatcctggctcctggccctcacacaccctttctccccctccctccttctctcctccctcctgtctgctctttcccctctctctcctgaatccctcaggtaccttccatgggccctgacccctccttttcagaggctccaaagtgagccctcaaaacacttggtaaccttggacatttccaaaactggagagacttgaccacagcatttttatgagctaggaaggtcctccagagctcttgcctaaatttttctgctgatgagaagagaacaagagtttccatctgatctggtcctaaggcaacttctccttggagcagagtctgggcaggaagaagggggttgcccagggccctggacttgcccctcccagctgctctgctcctctccccttcactgcgggaggctggccagggatcaggaacctccgttctccacagatgctgggattccaggctcaaatctaaatattggctgatttaggaggtgaagggaggcaattccctggagggaggtgtcaggatttgggacaagagcagcatctagttaccatccacagagaccccaaggacaggaatccactggtagccggttggaggggatcccatgaaaacaagatgaaacgcgtgcattagtactggaaccaagatcaggagatgaaaaactacactgtcctaggggatgaaggaattagggaatcctggaagtaaaatttttcatataggtcatttcttccaaagagacatagggcaatggcccaatgacgtgaagaaaagaaaactcagggtctaggattgaggggaggcagcctttttagtggagacctgtgacctggaggcccagggtcatcctgacaggggagcggtcttgctggtcgctgggtccgggactccaattgcacacagccagtggcatggagggtctgtgaccacgattgggcaatttcccccattctgcttatggagcaatagagaggaacctcactggaattatacagaaaggttccagtgagacttgaactctgatcactgtattcagagtccaaagtggtcaccattacaccatggaacctcacactagcttataactggaggtaactgagttcatacttagcagccatagttcccacacacctatgttaaggcatttcttctgatccctcaagcaacaccaaagaaggtggacctgcgagagaggattcatcctctttctttctctctgccctctcctttgatcaacttttatcatttcatttgcacctcagaaaatgaggcaaaatccagtttgggcttagggccagagaagagcccttgaggcctccctctggaaaacatactctctcagtttaccagagtttcctgtaccaaggggaaatttccgcaaacagtagtgttatattctttttgccttccctcttttccctttgcccagggaggccagatgattgtgagaacaggacttgggacttcctgggtgtcttgcccccatcctccatgtgataaataatggctgacaccaagcaagtgggattcggaggcagggaatctttcattttcttcttcatatacttctatgcatttgtttggttggttttggcaagattttctcaccagaaatggagaatttgttggatttaaaataaaaagtaatcagccatgttttacatttctataaaacactcaaaccaggccatactcccctgctgtgcctcaaaatcaaccataaactgtcgaggtcaggaggcagggccctgacacttaagcacagtgtgtttcctcagaattggccaagttgacgccactccaatttctcaatataccacaacccattaattggggtttttaaaagtgtacatgtatttttaccaaaaccccagggcttcagtgttctcagcacacagaaagacaatcattgagacattgagtattgctgaggaagaaggctttaatcaggtgctgcagctgagtagacaggagatgagtcttaaatctgtctccctgattgactaaagttaggggtttatatagcgcagaagaaaagttaactgtgtgtaggaaaagaggaactagggaggggtgaggaagcactcgtgatgagtgaggggactggcatctcattgtctggatgctgtgattggctgagtttcaggtctctgatgctttttgagaggcctgagagtcctttcctgaggaaggaactcagataaaacaaatataagtttgttttatagaatggcttgacctcaggagtttgaaaccagcctgggcaatatggtgaaaccctgtctctaccaaaatacaaaaagaaaaagagggttgcttccaagatggctgaataggaacagctccggtctacagcttcaagtgagatagacgcagaaaacaggtgatttctgcatttccaactgaggtacctcattcatctcactgggactcgttggacagtgtatgcagcccatggaggatgagccaaagcagggtggggtgttgcctcacccgagaagtgcaaggggttgggggatttctttttcctagccaagggaagatgtgagtgactgtacctcgaggagcagtacacccctgcccaaatactgtgcttttttccactgtctttgcaaccgacagaccaggagattccctcttgtgcctggctcggcaggtcccatgcccatggagccttgcctgctgctagcacagcagtctgagatcaacctgtgacactggaacatggcagggggagggggttctgccactgctgaggcttgagtatgtggttctatggtcacagtgtaaataaagtggtagggaagctcaaactgggtagagcccactgcagctcagcaaggcctactgcctctagattccacctctgggggcagggcatatctgaataaaaggcagcagacaccttctgcagacttaaacgtctttgcctgacagccctaaagacagcagtagttctcccagcatggcatttgagctctgataatggacaggcagcctcctcaagtgggtctctgaccaccatgtagcctaactgggagacacctcccagtaggggccgacagacaccttatacaggtgggtgcccctctgggacaaagcttccagaggaaggatcaggcagcaatatttgctattctgcagcttctgctggtgatacctgggcaaacagggtctggagtggacctccagcaaattccaacagacctgcagctgagggacctgcctggttagaaggattaacaaacagaaaggaatagcatcaacatcaacaaaaaggacatccacactaaaacctcatctgtaggtcaccaacatcaaagaccaaagtagtacataaaaccacaaagatggggagaaaccagagcagaaaggctgaaaattccaaaaaccagaacacctcttctcctccaaaggaacacaagtcctcaccagcaagggaacaaaactggatggagaattagtttgatgaggtgacagaagcaggcttcagaaggtcggtaataacaaacttctccgggctaaaggagcatgttctaacccatcacaaggaagctgaaaaccttgaaaaaaggttagatgaatggctaactagaataaacagtgtagagaagagcttaagtgacctgaaggagctgaaaaccacagtatgagaacctcgtgaagcataaacaagattcaatagccaattcaatcaagcagaataaagaatatcagtgattgaagatcaaattaatgaaataaagcgagaagacaagattagagaaaaaagagtaaaaagaaatgaacaaagactccaataaatatgggactatgtaaaaagaccaaatctacatttgatagctgtactgaaagtgacagagagaatggaatcaagttggaaaacgctctgcaggatattatccaggagaacttccccaatctagcaaggcaggccaacattcaaattcaggaaatacagagaacgccacaaagatactccccgaaaagagcaactccaagacacataattgtcagattcaccaaagttgaaatgaaggaaaaaatgttaagggcagccagagagaaaggtcgggatacccacaaagggaagcccatcagactaacagctgatctcttggcagaaactctacaagccaggagggagtgggggctaatattcgacaatcttaaagaaaagaattttcaacacagaatttcatatccagccaaatgaagcttcataagtgaaggagaaataaaatactttacagacaagaaaatgctgagaaattttgtcaccaccaggcctgccctaaaagagctcctgaaggaagcactaaatatggaaaggaacaactagtaccagccactgcaaaaacatgccaaattgtaaagaccatcgatgctaggaagaaactgcatcaactaatgaacaaaataaccagctaacatcataatgacaggatcaaattcacacataacaatattaacattaaatgtaaatggactaaatgctccaattaaaagacacagactggcatattggataaagagtcaagacccttcagtgtgctgtattcaggaaacccatctcacatgcagagaaacatacaggctcaaaataaagggatggaggaagatctaccaagcaaatggaaaacaaaaaaaggcaggggttgcaatcctagtctgtgaaaaaacagactttaaaccaacaaagatcaaaagagacaaagaaggccactacataatggtaaagggatcaattcaacaagaagagctaactatcctaaatatatatgcacccaatacaggagcacccagattcgtaatgcaaatccttagagacctacaaagaggcttagactcccacacaataataatgggagactttaacaccccactgtcaacattagacagatcaacaagacagaaagttaacaaggatatccaggaattgaattcagctctgtaccaagtggacctaatagacatctacagaactctccaccacaaatcaacagaatatacattattctcagcaccacactgcacctattccaaaattgaccacatacttggaagaaaagcactcctcagaaaatgtaaaagaacagaaattataacaaactgtctctcagaccacagtgcaatcaaactagaactcaggattaagaaactcaatcaaaaccactcaactacatggaaactgaacaaactgctcctgaatgactactgggtaaataatgaaatgaaggcagaaataaagaggttctttggaacccacgggaacaaagacacaacaaaccagaatctctgggacacatttaaagtagtgtgtagagggaaatttatagcaataaatgcccacaagagaaagcacgaaagatctaaaattgacaccctaacatcaccattaaaagaagtagagaagcaagagaaaacacattcaaaagctagcagaaagcaagaaataactaagatcagagcagagctgaaggatatagagacacaaaaatcccttcaaaaaatcaatgaatccaggagctggttttttgaaaagatcaacaaaatttatagaccgctagcaagactaataaagaagaaaagagagcagaatcacatagatgcaataaaaaatgataaaggggatatcaccactgatcccacagaaatacaaactaccttcagagaatactataaacatctctatgcaaataaacaagaaaatctagaagaaatggataaattccttgacacataaaccctcgcaagactaaaccaggaagaagttgaatctctgaatagaccaataacaggatctgaaattcaggcaataattaatagcttaccaaccaaaaaaagtccaggaccagatggattcacagcagaattcaatcagaggtacaaggaggagctgatatcattccttctgaaactattcccatcaatagaaaaagagagaatcctccctaactcattttatgaggccagcatcatcctgataccaaagcctggcagagacaaaacaaaaaaggagaattttagaccaatatccctgatgaacatcgatgcaaaaatcctcaataaaatactggcaaaccgaatccagcaacacatcaaaaagcttatccaccatgatcaagtgggcttcatccctgggatgcaaggctggttcaacatacacaaatcaataaacgtaatccagcatataaacagaaccaacgacaaaaaccatgagtatttcaatggaggccgaaaaggccttcgacaaaattcaacagcccttcatgctaaaaactctcaataaattaggtattgatgggacgtatctaaaaatattgagagctatttatgacaaacccacagcaaatatcatactgaatagacaaaaactggaagcattccctttgaaaactggcacaagacagggatgcccgctcccaccactcctattcaacatagtgttggaagtcctggccagggcaatcaggcaggagaaagaaatagagccttttcctcaattaggaaaagaggaagtcaaattgtccctgtttgcagatgacatgactgtataactagaaccccccatcacctcagcccaaaatctccttaagctgataagcaacttcaccaaagtctcaggatacaaaatcaatgtgcaaaaatcacaagcattcttatacaccaataacagacaaacagagagccaaatcatgagtgaactcccattcacaattgcttcaaagagaataaaatacctgggaatacaacttacaagggatgtgaaggaactcttcaaggagaactacaaaccactgttcaaggaaataaaagaggacacaaacaaatggaagaacattccatgctcatggagaggaataaacaatatcgtgaaaatggccatactgcccaaggtaatttatagattcaatgccatccccatcaagctaccaatgactttcttcaaagaattagaaaaaactactttaaagttcatatgtaaccaaaaaagagcccacattgccaagtcaatcctaagccaaaagaacaaagctggaggcatcacactacctgactttaaactatactacaaggctacagtaaacaaaacagcatggtactggtaccaaaacggagatacagaccaatggaacagaacagagcccttagaaataacaccacacatctacaactatctgatctttgacaaacctgacaaaaacaagaaatgcggaaaggattccctatttaacaaatggtgctgggaaaactggctagccatatgctgaaagctgaaactggatcccttccttacatcttatacaaaaattaattcaaggtggattaaagacttaaatgttagatgtaaaaccataaaaaccctagaagaaaacctaggcaataccattcaggacataggcatgggcaaggacttcatgtctaaaacaccaaaaacaatggcaacaaaagccaaaattaacaaatgggatctcattaaactaaaaagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaaacaaccccagcaaaaagtgggcaaagagtatgagcagacacttctcaaaagaagacatttatgcagccaacagacacatgacaaaatgctcatcatcactggccatcagagaaatgcaaatcaaaaccacaatgagatatcatctcacaccagttagaatggcgatcattaaaaagtcaggaaacaacaggttctggagaggatgtggagaaataggaacacttttacactgttggtgggacgtaaactagttcaagcattgtggaagacagtgtggcgattcctcagggatctagaactagacataccatttgacccagccatcccattactgggtatatacccaaaggaatataaatcatgctgctataaagacacatgcacatgtatgtttattgtggcactactcacaatagcaaagacttggaactaacccaaatgttcatcaatgatagactggattaagaaaatgtggcacatatacaccatggaatactatgcagccataaaaaaggatgagttgatgtcatttgtagggacatgggtgaagctggaaaacatcattctcagcgaactatcacaaggacaaaaaaccaaacaccgcatgttctcaatcacaggtgggaattgaacgatgagaacacttggacacaggaaagggaacatcacacactggggcctgttgggtggggggtgtggggagggatagcattaggagatatacctaatataaatgacaagttaatgggtgcagctcaccaacatggcacatgtatacatatgtaacaaagctgcatgttgtgcacatgtaccctagaacttaaagtataataaaaaatatatatatattgaaaaacaaaaaaaaaagagtcaagacccatcggtgtgctgtattcaggagacccatcacacgtgcagagacacacataggctcaaaataaagggatggaggaagatctaccaagcaaatggaaagcaaaaaaaagcaggggttgcaatcctggtctctgataaaatagactttaagccaatgaagatcaaaagagacaaagaaggccattacataatggtaaaaggatcaattcaacaagaagagctaactatcctaaatatatatgcacccaatacaggagtgcccagattcataaagcaagttcttagagacctaaaaagagacttagactcccacacaataataatgggagactttaataccccactgtcaatattagacagatcaacgagacagaaaattaacaaggatattcaggacttgaactcagctctacaccaagcagacctaatagacatctatagaactctccaccccaaatcaacagaatatacattcttctcagcaccacatcacacttattctaaaattgaccacagatttggaagtaaaacactcctcagcaaatgtaaaagaatagaaatcacaacaaactgtctctcagaccacagtgcaatcaaattagaactcagcattaagaaactcactcaaaactgcacaactacatggaattaacctgctcctgaatgactactgggtaaataatgtaatgaaggcagaaacaaagaggttctttggaaccaatgagaacaaagacacaatgtaccagaatctctggtacacatttaaagcagtgtgtagagggaaatttatagcagtaaatgcccacaagagaaagcatgaaagatctaaaatcgacaccctaacatcacaattaaaagaactagagaagcaagagcaaatacattcaaaaactagcagaaagcaagaaataactaagatcagagcagaactgaaggagatcgagacacaaaaatcccttcaaaaaaaaatcaatgaatcaaggagctggttttttgaaaaaaatcaacaaaatggatagacccgctagcaagactcataaagaagaaaagagagaagaatcaaatagatgcagtaaaaaacgaaaaaagggatatcactatggatcccacagaaatacaaactactctcagagaatactatgacacctctatgcaaataacctagaaaatctagaagaaatggataaattcctggatacatacagcctcccaagactaaaccaggaagaactcaaatcctggaatagaccatcaacgggttctgaaattgaggtgataattaatagcctaccaagcaaaaaaattccgggaccagacagattcacagccaaattctaccagaggtaaaaagaggagctgataccattccttctgaaactattcgaatcaatagaaaaagagggaaacctccctaactcattttatgaggccagcatcatcctgataccaaagcctggcagagacaaaacaaaaaaagataattttaggccaatatccctaatgaacatcgatgtgaaaatcctcaataaagtcctggcaaaccgaatccagcagcacgtcaaacagcttatccaccatgatcaagttggcttcatccctgggatgcaaggctggttcgacatacacaaatcaacaaatgtaatccatcacttaaacagaaccaatgacaaaaccacataattatctcaatagatgcagaaaaggccttcaacaaaactcaacagcctttcatgctaaaaactctcaataaactagatattgattgaacatatctcaaaataataagagctatttatgacaagcccacagccaatatcatactgaatgggcaaaaactggaagcattccctttgaaaactggcacaagacagcaatgctctctctcaccactcctattcaacatagtattggaagttctggccagggcaatcaggcaagagaaagaaataaagggtattccattaggaaaagaggaagtcaaattgtccctgtttgcagatgacagattgtatatttagaaaaccccatcgtctcagccccaaatctccttaagctgataagcaacttcagcaaaatctcaggatacaaaatcaatgtgcaaaaattagaagcattcctgtacaccaagaacagacaaacagagatccaaatcatgagtgaactctcattcacaattgcttcaaagagaataaaatatctaggaatccaacttacaaaggatgtgaaagacctctgcaaggagaactacaaaccactgctcagtgaaataaaagaggacgcaaacaaatggaagaacattccatgctcatggataggaagaatcaatatcatgaaaatggccatactgcccaaggtaatttatagattcaatgccatccccatcaagctaccactgactttcttcacagaactggaaaaaaaactactttaaacttcatatggaaccaaaaaagggccctcatagccaacataatcctaagcaaaaagaacaaagctggaggcatcatgctacctgacttcaaactatactacaaggctacagtaaacaaaacagcatggtactggtaccaaaacagagatatagaccaatggaacagaacagaggcctcagaaataacaccacacgtctacaactatctgatctttgacaaaatgacaaaaacaagcaatagggaaaggattccctatttaataaatagtgctggaaaaactggctagccatacgtagaaagctgaaactggatccattccttacaccttacacaaaaattaactcaagatggattaaagacttaaatgtaagtcataacaccatgaaaaccctagaagaaaacctaggtaataccattcaggacataggcatgggcaaagacttcatgatcaaaacaccaaaagcaatggcaacaaaagccaaaattgacaaatgggatctaattaaactaaagagcttctgcacagcaaaagaaactatcatcagagagaacaggcaaccgacagaatgggagaaaatttttgcaatctatccatctgacaaagggctaatatccagaatctacaaagaacttcaacaaatctacaagaaaaaaaaaaaaccccatcaaaaagagggcaaaggatatgaacagacacttctcaaaagaagacatttatgcagccaacagacatatgaaaaaatgctcatcatcactggtcatcagagaaatgcaaatcaaaaccacaatgagataccactcatgccagttagaatgatgatcattaaaaagtcaggaaacaacagatgctgtagaggatgtggagaaataggaacgcttttacactcttggtgggagtataaattagttcaaccattgtggaagacagtgtggcaattcctcaaggatctagaactagaaataccatttgacccagcaatctcattactgggtgaatacccaaaggattataaatcatgctactataaagacatgtgcacacctatgtttattgaggcactattcacaatagcaaagacttggaactaacccaaatgtccatcaataatagactagataaagaaaatgtggcacatatacaccaaagaatactatgcagccattaaaaaggatgagttcatgtcttttgcagggacatgcatgaagctagaaatcgtgattctcagcaaaatatcacaaggacagaaaaccaaactccgcatgttctcactcttaagtgggagttgaccaatgagaacacatggacacagggaggggaacatcacacactggggcctgttgtggggtaggaggctgggggagggatagcgttaggagaaatacctaatgtaaatgatgagttgatgggtgcagcaaacaaacatggcacacgtacacctatataacaaatctgcacgttgtgcacatataccctagaacttaaagtatttttttaaaaaaaagattatttctttgaataagcgttctactctttgctccttctcaactccctctttaaggccaatgaatctttgattttctcttttcaggccctcttctagatctcttaagcattctgtgttcctgctcattcttcttttcttttttctcctctgactgtattttcaaatagcttgtttgcatgctcactaattctttcttctgcttgatcaattctactgagacccactaatgcattttccagctccagcatttgatttttttctcttacttcagtaatcttgttaaatttctgatatatttctgaattgtttctctgtgttttcttgaagttcattgagctttctcaaaatagctattctgaattccctgagaggttacacgtctccatctctccagggttggtcactgagtgccttacttggtccatttgttgaggtcatattggcttcaatgttattgatactgttgatgtttgtcaatatctgggcattgaaggataaggtatttattccagcctttgcagtcaggtcttgtttgtacctgtccttcagaggaccttccaggaattcaaagtgggctgacgagttccttaagccagtgatcactgcagccatttttgtactacagggcaccctaggcccaggtacactgcaattcttacagattgttaggtctccagccctgtggacttgggaaagatcagggattattctctgcattcccaggtaaagcccctagcttactttcctttctttcccccaagcaaaaggaatctctcttcaggctgcactgcctggagtgtggggaggtgtgatacaggcatttccatagctgctgcagctgctgccgtcatactggctcacaccacaagtccagggtcttccagacctatgcagcatcagggcttgcccaaggactgcggccactacagcctgcctgccactgaaatttatttgtagcccaataaatttccagtgataaagctggccagaattttggtgggttcttcctcctgaggcagctgattcccctgtggcccagggtgggtctaaatgcttcttttgtgggcaccagcctggaatcaagtgttgtggggttctgtccagtgtcatgtgtcactatggcaagactaagtttcaatataaagtcccacattttcctctttgtccccaagccattagattctctctcagagaatttcctgtggttgggggagaggtgtcataggcaatgcaagactgtccttcctcccttcttcaatgcatcttttcttgttatcatgttaaaaccaggtgctatgatctctcacctggttagccctcgtgagagtgttttcttgcatagatagttgttcaatttgatgttccttcagggagaccattgctggagaattctattctaccatcttactccaccttttacctgtttattttttaaatgtttctagtaaataattgtgaagtgatacgtttattttaatcttggggatcaaaagcatgtagctaagaacttttcccaaggaatattttaaaatttttatatcaatgtttatggaatgacatactttttgattcaaggttcttaaatgtagttttagttttgattcaatgttatagaacactgtttttttaaactgtgatctgcagcccacatgtaatggaatcacctggggtgcttatattaaaaaaatgcagattctagggctcacaccaactaaatctcctgggattggagaccaggaggtagttcctataatctccacagctgcttctaaggtacaccaagtttaagaaccattctttcatattttcagactggggattcttacaaaatgacaaagaaggaaaaccttaatcttttaaagttagagttcaagcattagactgtgcacttcttaaacacagtttgtctttcccattttctctttccagttctttatactgtcaaggaattggggcagaaatgggaaacaaagcagtgaaagaacaactatttatttctttatacacattttgcttcaataatcaccaaaaagactttcattttctgtcacccaccctgtccaccagttatgttggccttcaatatatggcgatagcaacataaataaatctgtatcatacatctatacacacaagcacattctatcaaaactgtgaagacacagactaggctttactatggctgggggcctctcccatgccacttaaaaatgagcacaggtttgctctatgcaagaatttcaacagaattggtctggccatcagtccccaatttccccgaggtaagataggacgacaaaatgggacaagatatttgaagtgaggtcagtccaatttggatatcatagaagaaaagaaataggatgtgctaggttaagcctgagatggtatctgggaagtcacattcatgatgtgaactgaaagaacacaggtgctacagtgcagaccaaaacccagcctgactcgacccaacagggtcaggtgtggatctgtgagtagtgctcactgagcccccacgagcagtgtctggcagggcaccgctgctccatagtgtgcttttagaacctgccagaggagctccagcaataggaccacgtgccccattcatcggaatcagggtcctatattcactgagttttccatctcaggacagctgatgaggcaagaaatgtgctcttgctagttcccaagctgctggggctgttgagaggcagtatcacaaaaccttctgtgcaaactatgcatcttcttcttagtgctgggccaagtggaccttggctaatcgtattccatagctgtcagaaaggctttctgcctttctgccagctccaccaggatacaactctgactccctcttctggaccctccagtggacttggaggaatgagacccagatgctcctcagcagataggtagctgcacaaaagggggacaggccaacctttcctgatgttttaaggacttccggtggctgcacttcttgcatggttcctggaaggcaagggtcacaaggctggagtacatggcagagcccttagggatttcacctgcagacaaacataaaacaaaccaaatcagtgtatattgccaggccctactgatggctacccgaagctggagtgagaactatggggtgaccaaagccaggagcacagtgagagccagttaagaggatgagctaagagcatgcactgcagtctggagaagcaacaggtgcccgaggttagggggagcctccccacctccctgtgtcctgagatccctgctccaattcactgcacactgggtggctggatcctaccactccctcttcaggggccaagtgactctccaaatcactttgtctcagcagaaaggggcctttgtcatctccacccaagaaagaagtgcttagcatgaaacatgcacatatagaagcagcctgttgtaggaagaagaggacactctgcagggaagtcctctgttaagtttatgtccagtcgccataatgaggatgtggaggggcaaagtccacagggacctcagagctcaactaagtccagttccatctttgacaggtgagggtgcagcagtctcacagagactaagggacaagccaaagccacacaccagttagtgataagccagggattaggaccgaggcctcgggtcctttccagtgatctgtgggaggtggaggggaaagcttccacactggagaaagccagtggatactagaaacatttgggttacctttcagtggatactagagactttttgggttaccttttctgggacaggaataaggctttacacaggcaatcctgtaagtgctgctctaaagaggctcaggaaagagaagaattatcagagaaaaacaaaacggaattagtttagaaaaaaaaaagtacaagttaaactggcccaagtcattttcacactatggagatcaacattctctcaggttatggtttagaaacatttctaggaatatgctcaattgcttatggcaaagctttgaagtccacgttaaaaggtttagtttctgatttttaaaccatttcatatacctcaagtttttcttcaaagcaattcctagggaatgattaaacacttagtgttttaagtaaatgtagataatgtctgatatatatataacatttttcccctgaaggttcagttgttatttattaacaaattctcttttagacaaatgagacccaaaagatctcttttgtcgtgttacttaaagaaatatcaaaatcaaattgctgttcttaacccaggagtgtgcagtgaaatcagtttattaggttgcaaattgcttttactttttcatgaagagtagaacacataactggcctcaagatccctctaccaaaagctcattcagaggcagactcccaaatgtctaatgacttcaagagtgagctgaattgcatttctccagtctcctgacttggtatcaaagaagaaaaattggagtaaaaaggagagatgctaacaatgtgagagtgaaccaagatacaggggcaggagctgacggggtgggagggtgatgggaacagaaactagcaggaagcccactgaggacctgtgatcttacaagtggactggaaatcttctcctggaaggcgaaagcaggccaagcgtcacctacaagatctgctaacagatggtgatgggttggggacaggcttggtgcctctgactggtgcagtagtttccttaactctaggttagtccttgcattctttaaaacatcatgtgttctggttactgaaacaacaaaagagcaccacagagtagaaatcatcagcagaaattaaccctacttgcttagcatgagaatcctaaagcatttatttctctctggccattcagcttggagtttcctgctatccaccccctgtcctcccctccctctgcatccacaactgctcggggcacaggaggtttggggacatcaaatcagcctccactcccaacatccccaagccccccagtcactgctcatcagcagcacaagtggggcatcgggaagactgcccgtttcttcccccattccctctcagggaacctacgctggctgacaatgaactgctccatgctctctttctgctggttgtcgatcttcagatgctcagctgtgctctgaaggagccactcctgtttggatactttggttctcagttctagaagttccctttctgtcgattctctctggataagaggaacagactcttactgaacaggcagaaggcataaagcaccccgtgctttgtggctctttccagttcaaagaaggattctacaatcttctcaactcccctgaactggatttcctccttcacagcctcgaatacctccagctgaggacagtttaggatgaggccattaggtaggaatattgagactctggaattccccatgcagactagcacaggcctacacacctgtagcttaagagaaccttgcttcaggctggtataaaactcccagttctgaagaggaccttgctttagtcctgatatcagttctgtcactctcccttcacaggtaagattgagagttcagaaatgttctgttgggagagagagatctggactcaggaaagtttgcaagtttgtaaatatttgtgccaatatgaagatagcaaaacaccctctccctggaattagcatagttggatccaaaaggtattggtgccattgacctggagctagaatccctggggaggggatcctgaaacctgcctacacaagggtctgccaatcagagttagcctgagctctgagcagatcctgaggggaggctgactttccccaggcctggtccagcgatgccagcttaagtgatatgctgggattccaggcagtggctaaaaaggctgtttcatgggggcattctgtgataatttgaccacgggacctgagggttaggagatggatgctaaagctttaactgaatttcagctcatccaaacttcagagaggtaaagaaactgaacatttgtggattgccagggttatgatgtctctgccttctccacactccttcctcttcttctttggtttcttatccaggggccagggggctggtggggaatgggatgtatttagagctgcaatgaaaacagcgactgtgggtcagagatgtccctccagggacactcctctaagttcgtgtctatcccaattcactatgtggctcctgattttctggaaaagctgtgacattgaggagacagaacagtattggagggcaggagaactgggtttgaaccaagaaaggacactggtatcttaccactttgccaggcagtgcagggatgtgggtgcttggcagggccgctctccagaacatggtgaggagggaagccgactcctctagggcatggtgcagggcactggtgctgctccgaagctcatgaatgcctttgctgcctagcacctggggaaaggtaacaccacaggagcggagagattactttcttccccttgcatgggctcaagttcctttgtgagtgaggcacagaacatgggcctgcttgaacctgtgaagccgtcgcacaaccatttgcagctctcagaactaaggtgttgctccctttaccaggaatgccttcctccacctgcagaacccacaaggctttcaaaactcaccccccttgctatgtcctctatgaacctgttaccttccttgcctgagataaatgaccacatttgcattggcgctctcacggcacagaggatgacttctcatactgtgcctgtagccccttactgtgcttatctacttgagtgtgtgtcttgccctctagtgtgggggctccgtggaggcagggctgtccctacgcacctatgggtctccagcagctcagacagcacagccacaggttcctggtttctctcactggcaaggtgctctcagaagctttgctgactgccttccctccctctatgcagtctgcacaaggaaatgccttggctgccaggcttctcgccccttccacacgtgggggccatacacctgcaaatccttcagtttctgtccatcccattgagtctactctgcccacagatggttcatgtgcctgcatgactgtggtagataataagctaccaaaggctgctaggcaatgcgacatgtttctgtgggtttgaggggaaatatccagtcagctacatatggaacagagcagaactcacagtgaaaataggagatagagaagaaagggcctggctgctatacatggaagaggaagcctcagctctggagagatgcaaagcatgaaaaaaaacaaaaatggtgggagaatgagataacatcaaaggaagaaagggcacaaggaaagagtgcacctaaagctacagatgtgattacctctgtgccttgggcttcaaggccagggaagctgcacgctgatctcacaagagacactatctttttgaccagcagcttgccctccgcaatctgctgtcttagggcactgtagtcatcaatgtggccaatgacatggcggccatgcttactggcaaaggagccatcagtagcatcaccctccagcttgggaggggtcttcattactggagaagtatccaaacccaagcctgaaaaagaaaatgacaacacaacagaatcttctgttattcatagtgatatcatcagtttactccaactcaaaagaggtaggaaacaagaaaaggacgaggccgggaacaagaaaggaagccttggaatgtacaagggtggggcaaagtccatagagatcttctggcttctatatttttataatctttcttacattatctcttaatgataaatttgccaggagacaactttttcattattggataatgaaataggacaaatcacaataaataataagtttctgagtagagaagacacagacaattaaatcaagctggatacagagagcattttcaagaatggagagattacggtgcaatgaagcaaaaacagcagtaggaaaactacaggaggatgaacaatggcaagaaaggcagccacagaaggtgcagggagtagggctaaaggacttggggcatgcagagaaaactctctaaatacagataatatgtttagagacaaccaaaggttgtttgcattaatctctttccatcatcagtccctgggccctgtagttgccatatttaccatttgttctgttgattatggccgtttctgagccagaagtagaggaagcagagctggggaggaccagagcttgggaattcataccaacatcccggactggaggggacacagcagaatctagggagtaaaggcaaccacagttttcaggagccctggaacaccctgcatgtgaagcacatgcacacctagccgtcaccactgaggactaattttcaccaagacattccagataaattctttccacaacaacaaactcatactggggttgagtggaagcaaacatggctgtaacaagtctattcacttaacttctttgagcctcagtttccttttatataaaataaggatgataacacttacctagtggagttagcagatgcttaaatgaaattgcatatatggtatggctagctcagggtctaacagggaagtcattcaatgcctgctgtactagctgcagacctgagaaataccaacagcagaatcccatgtggtgctgccaggcacggtggctcacgcctgtaatcccagcactttgggaggctgaggtgggcagatcacgaggtcaggagatcgagaccatcctggctaacacggtgaaaccccgtctctactaaaaatacaaataaattagccaggtgtggtggcgggcacctgtagtcccagctacttgggaggctgaggtaggagaatggcgtgaacctgggaggcagagttgcagtgagcggagatcacgccactgcactccagcctgggtgacagagccagactccatctcaaaaaaaaaaaaaaaaaaaaaaaaaagctgtagagctaaggtctatgaatccacattttacttaagttccacaggtgattcttttttttttcttttttgagacagactctcactctgttgccaggctcgagtgcagtggcaagatctcagctcactgcaacctccagctcctgggttcaagcaattctgctgcctcagcctcccgagtagctgggactacaggcacgcaccaccatgcccagctaatttttgtatttttagtagagatgggctttcaccatgttggccaggctggtctcgaactcctgacctcaggtgatccgcccgccttggcgtcccgaagagttgggattacaggcatgagccacaacgcccggcccacgggtgattcttaagcatgctaaactgagaacccctgagctagaggatgtacaggaaatgggtaattcacaacttgaaggatcagtagtggcctatgcacatagatcggatttctcagaatccaggagtcttggaacctagagcagagcttgtctggtgtgtttctgggaggaaaataggacatagcatacagacagacaatctatgagatagtttctcaataaagaaaaaggggataggcattttaccgaaagtgggatgtgaatgggggataaagagggcacatgtgtatatggaaaaggatatttaatattatgttctaactttatgttttaaaaaaactgatgtttctaaatacaaacaaataaaagaaaaattcaacaaaactttcttgaaaggaagaacaatgcgttagattctaccttctacagtatcagtgattctgtaggttgggtggagggttgaacaaatcagagtttcaggttagtaactctgaggacaaaggaaaataatccacagggatatctacagagggtttgattgtaggttcaacaatagaatcaaaagagatgtactgttcttacccatgacaactcaattacatttacatatgcaaaaatttaagtaaaataatatgctttaagtagaacttaaggaaaaagttattatgataattcagggcaaaagaatcagcacttagaacaatcacaagaatttttaaaaaattgtttgacaaagtatgtagtatagaagcaaggtttagatgttagaaattgggagccacagatattatgcaaccttgagaaagtcacttgaaactttctaggcctgagtttcctcagctatgaaacaaggacatgaggctagatgcctgggcccttttcaaagtgctaacattattcagggaagtttaagtggtatgtaacatgcagggaaacaacagggcatgatttagaagtcgtacagctgtactttaaacaggcagtgatgatgatagtcctgggagcgaatgaataaatggatcagccctacagtatcagcatgttctccaaggagcttttgacaaaaagccatcaaagacagagtggccaatctaaccaatgaatgagctatctgtgatttctgtaaaattactaaagcagcagagatgattaaaattgatactctatgattcaaggacttatgagcaggagctgagaggagagggaggggcccctacacaaaccctgccaagcagccaacgccgcagctactggaaggtggaggtgaagccaccctgccaagcagccaacctcactttttggtaattatctttgtgctgatgctgccagacaaactctctctacaaatctcagcatgtggaaaaaacagaggcaggaacaactgcccagcacctatttctcgaagacacccttgaagttactcatcaaagttttaattaaagcagaacttacggcttttcctcaaatgggaatttgttaacttttagactttgttattgttcattttgggcctctgtgcaaatctgatatcctgtttgaatgacattgttttgtttttaccctattgcttcatatctgtcacaatgttaagtcagttctcaacattaaggcattaaaaattagcttttctcaaatgctcagcatcactaatcattagggaaatgcaaattaagaccataatgaatatcatctcacacctgttagagtggcatttatcaaaaaggtgaatgatgtgttagagataatgcagagaaaacggaaaacacatcgtgaataggtatgtaaattagtacagctggtgtggaaaacagtatggagtttcctcaaaaaactgaaaatagaatctaccctatgatccagtaatcccatttctgggtatatatccaagggaactgaaatgaatatgttaaacgtatatctgcactctcatgttcattacagcattattcatgatagtcaagatgtaggacaaacctaggtccatcagtagatgaatgggcaaataaaatgttgcagataatacacaatggaatactatttaaccttaaaatgttgggggataggtcctgtcatttgtgacaacatgaatgaatctgaaggtcattatgcttagtgaaaaaagccaggcacagagagacacctaccacataatctcacctatatgtggaatctaataaagttgaactcatagaagcagagagtagaatggtggttactagaggctggtggagtggggagggagagtagggagaattgttgatcgaaggtatcgacaaaaagaataggtcttaaggtatattgcatagcagggtgactatagccaataataatgtatatttcaaaataagagtaaatttccagtgtctcaccaccaaaaatgataggtaggcaagttgatgaatatgtaattggcttggtttaatcattccatattgtttgtttgtatatatatgtgtgtgtgtatacatataatcatatcataccccataaatgtatataattatgatttgtcaatcaaaagtaactaattttttaaatagcctttttgaagtttatcacactttgactactaatgtctgttctttgtatttgaatcttgattttttttcttcaagaggtgggggtctcattatgttgcccaggctggccctgaactcgtgggctcaagagattctcttgcctcagcctcctgagtagctgcaactatagatgcacactacctgggcttgaatctttattcttgattaactttttctccattacaaaagttcacataaaaaaatgcaatggttgattagtttctttcacagcaattttataggtatttattatagatcttacatctgcttgagaatagaattttgtgggagaaaatctagggaaaattactatcatgccagacttgaggcttcctgaggtggctgagtccaaaaaataaggaggaagcaagttgcattggccaaaaggtgattctcaccttggaagaaagacaaggttggatgtgtctgttagtgaaagtgtatgaatgcttggagtaggaagggagctttgtgtcaagcaaaagtttaccttccaaggacataacaaggagaagctcaaaatctatcttaagggaccacttccctggaaacaagcaaacaaattttgagaatctggacacaaaacagttatggtaaagtaagctttatttagttggtagcaggagagtcacaacctcaaactccagaaaagatgaagtaaatttgcaatgatttcatacaccaagattcctcctacccagagctgaagatgtattttcaaggaaaggtgatagaaagaaaaatgatgcttacccaagagattcttccatccagcaggcatatactttgtctatcatgagtcaagccctgatccaaaggcttgttaactcataattacactaagcatctctcctatgccaagtaatatggcaagtattgtgatggaaatactaacgccctaatgtaaaaaatacattccagggtgggctgacctcctcaaaatggggtctggtcagattctccatgctaggctacaggaaagaaggctgaagaagaagcaactttacaaagcagtttgcctacagttgagaattagagcaaatgacttgcagtacctggagtacttcagaccatatcaatcagaatctgactgtcttcatatctgtgtctcctgttcatttattctgaagttaatcctgtcccacagtcattataaccatcagtgaccagccaacctcccaatctagctgtctcagagtagacatttgttcatcctgcaggtccctctctctcacccaagacccttaatgacatcagagagtgaggacagagggatctctctggagggagagagatgtatataaagtcacaaccatcagtaaggaggactcaggagaagctgttcaagcgaaaagaaaaatggagttcatgcaagcactcaagggagaagggaaggttgggtacagctaaagcaacaagaaggtgatcctattataagaaggtgatcctactactataaagaaactgttgagaacatgacatatcccagacagctactcatgtccccaagtgccaaatcccaaaagatttgaggatgcttgcttgggctcttcttattggttgattcgatgtctcttctttttcttatgcagaagacatacaggcagacccagaaagcctcatttcttgtttagttttcctaatagccccaagaaagctatcactggaaagtccagctgcttgtgtgggatatctaccaatgattcactttctccttaagaatcataggcacagtccatctaggagatgagactgctaaatggcatggacaaagtggagacattataggagttccggtgagtgcttgtgagatcactattggtgacttaatctctgaagtccagattattcactcttgtaacatgctagttacatcttcactgatggtgggtggaagcaatgtttcagctcaagttctgaggtttaacaggggattgctgttgaagtaccatctgctgatcactgagtcaccatgacctcaatggtttgtcaggttgcataaggttctctttgcataatgagatttcactgagaaagagtcttgctttggaagcattccaatcttcttggagtttcttcccaagcaggtcctccgccctgccacctccccgagcagcccttcgatgactccctgtcttctgtggtgcatttcagttacaaaaagcccaagaggaatgtctcgattgtcttgcaagtaaaaattcttctgaagctatagctacagagaataaataggggcaaagctgggtaggagggggcaggaggcagaagaaagaggtacaacacaaaccaaagggtggattggagagaaaaatggagtgaagatatgggttggaaaggcagctggtttgctcaaggagaacaggaagatgactgagaagtggtttatataaaaagatatcttctcactctaagtctgtaagggccgcaggagaccatcagacctcagaagggctgtgtgtagtccaccctggaagccccagaccctgaaactgacttacttgctggtgactatggtgtgcggcctcctcaataatgtcagtgaactcagtgcttgcatctttggtgtcatcccctgcaggtgcacctggaaacaagtccagtaaagaaaagtgattcccttcacagatggcttccagagagcaggttaaattatactctttttgccagctgcctctcatttcttcctttctccatatacatggggaagaaattctccctagccagcagggctggcaagaaaaatagaactttttgtatcacagacactttcttattcatactcaagcctgagcctcacaacataagctgactttgcctgcacagacccatttctaaggagccgactgtcggatgcactggttaccccactcgaatgtcaagaaagcctgaattgttccccactgcctggctacataaaaactttctcttccataacatgagtctaacatgcctaaccctttccccaccactgagtgtctagaaattagagctgccctgaatctctcagaggtatctattgttgggatcagttgtgcatagggtgacaatctctctgaggaacttccctctgggggtcctgtgtcctagtaaggttcaggtctagtcaagattcaagacacccaatgattcagttgttccctaatttcttcctctaacctcccttcctcctcacctctctcaaactcttattctacgcaggcaccctttgcctgaagggttccttgcactgctttctccacatgagatttaacccatcctttcattctccagagatcaacacagccactctagggcccaaacatctacaccttgctctaaggtacaagtagctgcagtttgtggtatgggcaaaagtctaaggcagcactgaccaagaggactttctgcaatgacagcaatgttctgtgccagtgttgcccagtacggtggacacagtcatatatggctattgagctttgaaatgtgggtagtatggcccacatttcaaagcattcaattttaaattttattttagttaaattaacttatatttaaacgactacatgtggctagtggctaccctattggacagcacaaatctagggtgtttcttccttcttatattgattaaaattaagactgttcatacattttaagaccaagagctatgtttttacattactgtatttttcgggaagtgtagaaatttattatggttaatttatcaaagaaaatctactgtgacactcaccatgtcttatagaacctccccaacttaaagaatcttgaaatcttgttctgatcctagcctcggcaaccaaccagttacaactccacttctgaccactgattaacctggacctctaagagatgaggtggtgtgtccaaggttacacaactagccctcacaagagctgcaccaataagtcaagactgtggactcttagacagaagccactcactttttcttctggtgacaaatcagatctttatctttgcttcttcctccaagaccaaagaaccttcatgttgagttcagacatccaggcatgaaaggctttgcttgaatcatgagcattcactacccaatgcagataaggtaagcaggggcagttcacatctacatatttgcaatggcccaggctgatctcatagagtgctaagaggtagtaagtatgctgtgataacagcttaggtttcctcatctacaccatgaactttgtgttaactttggatcaaggaagggtcctgttcagtgtagcctctaccacctctaccactcagcatctttagagttctgtggcagacagcgtacaagaggaatttccaatacttcctcattcaaaccaaccccagaaaccatctcattcaggatgctagctgagtagagttgtatggacacattgcctaatctttggctgctttaaaacttactgaacccaggatactaatttacctaggacactcatatcatgttatgcttactttggaaaatttttccctgtaaaacagtagggatcacaatcttttacgttttttccagcaaaggaaatgaattgtctcactcagtgacagaaaacagactgttcacattgtttctcatttgaacatggggctagagaaggatcctgtaattgaagaaagttcagctctatgaggtcaggatcctcatcccctaccattgttgctgggttgtggagtcaggctgggcccacatcccaggaccattcctgccaggttccagaagcgagaattggaaagggtgactgtcactggtcttgaaggtttttatctgacacttcctgccctccacttatctttggcagcctttctggtgccacgtctgcattcttggataatgctccatcttacttcacttaagagcaggatgctatggttctggcttcataaggaattagatggagacaaataaatgctcatctcatctcgacactctgccacacaggggttttgtttcttccccttcattctctcttttttaagctagctcacagtcttcttccattacggcagctttaagggttgctcagccttttaccaatttgaattaaaatgctgaaactttttctcccatgtttgaggggtaaagctaaaaatttatagaaaatatggaaataaaagggtaagttatctcatacaaggtcctgtatataagttaacattagacatcttttactatttttcattttttaaataaatgagagaacttctcttttgtgagtggtacctttttctaaacttttacagcacaatgaaacactgtcttcagaactaacttggaatactttgaatttctaatttaaaggtaactatgctttcatattgatgactcttctgcttattttttgataaaatataaaatagtctgccacctttagattctctgaaagctaagaatctgttcatttaacttgcttcttcaataataagttttacatgttagactgccaattttatcaaaaacttttatttgaggcttcaataaatgttcttaacttgtggttcttggaagtttctgggctctgaacaatacaaaatggaggtgataccaagatgtccgttatttagatttataagattattttctatcagctatctaattctacaaagtacacaaaaataagcctctaaaacataagaccataaaatccttgggtgaaaatgtaagcattatgcaaatgtaaggtattcttatcactgaggcaaaaattcatacttttgtagaactttttgagtatggaataataattaagaacatgaactatggagatagactgtctagatttgaattgtgcttttttcgttagttatgtcaccttaggcaactcataacctttccataactaagtttcttcatttaataactagggttaagagcattatccactccatactgttgtgaagtttaaagggtttgctgattttgaagtgcttagtacacagtgtgtactcaataaataccatccttaaacaatattattattattgttattgtaggtaaactgaagtagtccatgggcttattagttgaaagctgagaaagttgaaggccatagaacctaaatagcatcagcagaaggaagttttatacttgatgttattatctgaatgatcttgattaattctacctgcacttcttcatttctgaatacttgtttcccccagcaggaggcttgaaatgacactctttgctctctgcctcacaggacatcgaaaaactaaggagttgtcagtaaagtaggttgaactctttggaataggtgccttacaaaaaggattactcatcattaaatgataactgtcttaaaactccaaaatgcataaataagccttaggggaaacttcatgacctctttttttgttttgttttattttgctttagagatgaggtctcattatgttgcccaggtgggtcttgaacagctaggctcaagggatcctcccgcctcagcctccaagtaactgtgaccacaggtgcatgccgccacacctggctcatgacatgttctttagtaatgagtccaaactgggtggagtcaagaccatttcccccaaattctactctgtagtcattattatcttcctttaagccattaatatgggatcaacagaaaaggagtgatgtttttccatatagttacttagaacatagcaagagatcatattttattcattttaaaaggtgatctgaagaactaaaactttaagcatgaataagttggcagtgccaagtgttctttccttcggtactgagcccttgtgtctaatactgtcagcccaatttcactctgactcccaggtacaccgccatgcattcattacaagaacgctcacattttcatgtcatgaaccaactattgctgactttaatgttatggtgctgtatgagagaatcaaggaaaagaggcctcctatcaaactacaatttcacctgcacacattcccttcaggatcataagaaaactattaagattccatatagtcctccatagtttctgctaagaaataaaattctctatctagacagattctgatcgtggaacagaagtggtagaaaactgctgtctgcagtcaaacccctttatggtgtatctttgtctttaaattgcaacatctcttaagtagccttagggctttccagctcacatgtttcagaaagtagctgttttaagtgacttgaaaaggccaaatcataatctaaaatacttttgggggtatgaaatcccactaaaattctggaaagagtttctacttctccaaaagggtaattattcaatataactacagtcttctatccttaggctaaccaaggcacatgtaaattaggactcctgggcagaccaggagatatgaccactgcacctattttgtgatgccataattctgtaatgtcaagaaattcttcctgctcatggtctctctttttttcttcaaagaacacaagaaacaggcttttctaggaatgtttagagacagcactacccaccgcagttggctcctcaaacgtctgtcgtgctttctgctattctcctacagcaaagaaagcaaggaagggtttttaaggtaaattagcctatgtcgcatttctggggaaagtgtaacactgtttctttagtgttacacttttcatttcttcaagaggagaaaaattggggtttcttcttccttcctttagttaaataaatactcattctacaagccttgctttgacttggaatttagtaaataatcaatagactgattctcctataaggaaaaaaaagatacaagctttctctacttctttttttaataaatattttaagaataaaaccaaatagtttctattggcctttgataagtttattggatcagtaacaattttttgtgtctcaactaagatagctaaaattctaacacttatatgtaaaaattacactccattttagcacaaatgttaacacaaattaacagcacagtgccatgaagaaatgaaaaatatacagcttattttggtggggaaatggtcctggaaataatgtaatgccaagtttctgatcatttaatacatcactcacctccttcttcatctgatgttatgaaccactttatttatttatttatttatttatttaagacggagtttcactcttgttgcctaggttgcagtgcaatggcatgatctcggctcactgcaacctccacctcccaggttcaagcatgaagttatgaatcactttaattcttctcaacaacctacaaaattttaagtgaaaactaacaagacttcatggacaaagatagaaactcataatttataaaatgtgctgatatatgcacatgcctccaaaggttatagattgagagagaggtcactatcttggagctatgactttgattattgtaaaaagaaacactacatattcatgttatacactaaaagtaaacctgcaaggaagccaatttggtttatgtacttaaaacccctattctccatattattttaaatacaacattttctgatgttgctgaactttctattttacccttccagtttaagtaagagcaaaacaatatgataaagatttttacttctggaatttgattttaaacaacaaaaagggagagtaacacaaaaataatcagtatgtcactttataagtttcattattcttatttgaaacccggtagaattagtattgtcaggaccacagttttgtgtttatttccgtttcccattctttgttggaggcaaattacgatgctattttttatttagaaaattcatcttggcccaggtgagaacatggagaagttgaagacttaccttctgttaacacttagactacttaaaagcaacaggcttgttattcgatcataataaaatgttttaacaaagctactggtgcaaagggtgagaaggtggcttaaatccacactctaaaacacattataactgaaataactgaaatatacactatataaaaaacattataactgaaatatacagaaatcactcgaatatattatcctactgactcattccttctgtttattactgtattgccacattggagttccatatttccagctattctttctacggtacaaatggttccacactaccaaagagaaaagaaaagctcactgagctttaaccctgagagaactgagagaaaatactctgtgctggtatctcacaggatatatctggaaaagaaatctaatttcatttgttctatctctagtacaatttctacacagtaaaatggaaaacggactttaagtgtgtgtgttgctaatatttcttcctaacctcacaggaagtttgtcacgtttccttgcaggatactgactgtaaacctgcagaatactacataataccctatttgaaaaggccacttgagcttttcagggatgccaaatgtcaagattttgtgactgttttatataaaaagatcatgaaatgagaaaacaagtttatcctatcaatgggaactagagttttctaatactacctcaagaaaagcaaaggtattattgttctctctaaggctcacagtccaaaggaaagtgactttaggtagctcagtcaacctttatttctcaatgaaaaggacaattttcagtataatgtgatctgctactcctttccacaatcagaagactccagatccaactggaagatcaacatagagagaactgaaatcagtcttcttgaacagtttttgaagctatgagccaaacatctcatgacccagacacggaattaggaggatgaatgagcataaaagtgataggtttttttatgtacatcggccacagagtttacttatgcataaaccgtgtaaagagaatatactaaagaaccctcaaggaaactaattcttatggttaggaactcatatcctctacaggttaagattttctggatccttaatagatctcttgctatatataatgtaatagaaacatcttttaaaaatataaataaggaaaaatgtatttcctctaagaagcaaaggtactgaaaatattactgctgtccacagctgaatgaagagaagagggtgtggagaagattcggtggcagataagagtacacactatcaaaggaaaaggctgacctactaacatagtccaataatgtcttgtcaaaaaagttataacttggttatctaaaaagagaacatcagatgaatgttgatttatactaggtactaatagtcatcaaattttccatactataaactttcaatagaaaagagtttgggaaaatatctatctaaggacatttatttcactcattaaataagtcctcttggaggttctttgcaactctatacttctaaaacctacagatttcatctaccctgaactcttacaaccattactctgcattatttgctattattcaaaaaggaaacatgagaaaaacaaaatttatcatatggatttttttctgaatttaagttctatgcttccaattaagcatggcctaagtaaaaatttacttcattatttttatttgaagattatttttactcaagcacaaggttctataagcacaggatgctttatctaaaattactgtcatgttgaaaaatgactgtcaaaggaagaataatccagtatgagaaagagtctgtgctcctgaagagaaaatggaatattatatcatgctaaatattattaaatgatgtgtccaacacacaaagttgttagaccagcaagctctctccagataacactgtttgcaagcctcattccagctatctagactagaaaaagttagtaccatattttagtcacatttatgacattaagatcagacttttaatttatccttctatcaatctactcttgctggaggttgacagaagtaggagtgattattaacataaactgtaatcactatgagccattagaaaccaagaatcacccggagctgaatcttaatagcagactcagaaggcttctctggtctattagtagaattaaggaaagatgttccctaaatgccttgttgtgatgacacaacaaactagtctttgatgggttgacatttctatagctccattaccttcctctttacttctggaaagttacaaaaaattttgtgcaagaaagggtctcttaaaattagaagactaagaaaagtggatggatcggcctacacttcctatctccttccttaaatgactcctttttcctcaaaagccattgaaactgaaatggcagatccattaagagtaaggcttatggctatcaatctttggcaaattacttaatcagaagattccagagtgcttccccagtagaacattttctccctgtccactctagtttgactgatgctctatctgttatagacacagctaaagttacagaaacagatgaaatttagaacgtaatacaagccatgtcaacatgtgaaagaaataaagtgtcacataaaaaaaaaggaaggaaaaaaatcactgtgccccacttagtttagaaagggtattcagtcacatttattgtgctagaaagcctcaatccctgtcccaaattccatgtttaaagtaactgaaacctcagcttctaacctaggaaacttaaaaccagaggaaataaaaacaaattcatgatgttgaacccacaaagctgcaaagcaatcttggttacttttcacacttctgacattcgagacatcagaaatacaatctctggtgcccctctccttatacctgtcacgctgccacaagaaagcattgaggcaatgattaaaactataaacatacatctgtaacatttctttctaaactattctagcacttcaaagcctgaagcctattacttatttttatatggagaaatgtatgcatactaaatagtgaaaaacataggatcctatctagtgccacaaatggaagaagcaataccctcttctggctgtaatgagttatttggtgaaacactgaatgtaaagagggatactacatttgaaattatcttgtaaacagagaattctgactctggaaggccattctagaagtcatgttctgactaaatagcatgaccttggcttaaagaaacgtaaaggaatcagtaaagaacaaattttaagtagaatttaacctgtacctaatctaatttcacttgtgtacaacagtcaactctgagacagtattggaaataaaagttgactatgatcactttcatagttcttgcctctgttctttaacttggccttcccaatacttgcagtctactattacaagactactctcctggttttgattaccttctgataaggattatatcacttttgcgaagtcattcttatagactcaatctctttcccactctctcatcttaaaacttgtattcctttgatttaaaaaatgctctcactcaaagagaagttgactgaatggcaaaaatactacacacacatgcatttatgatatgatatgggacacatgaaatggattgtgaaagtgggggaagaataaactttattggcccacagaagggatgagggaatgagaaggggctagggataagaatgaacgaaaatggaaaaactaaaacagaatgatttaaaatgtgcaaatacactttgcaacctccacctttcaatttaggaattgatatatatgtacaatgagatccatgtaggctaaagtgagtttcactttgtagttgaagctacttgtaccagttctatcattagtaagtcaccgtttaattctgccaaagtcagacaaggatctttctggttagtgcaaacaaggtttttcatcttgggctgcagtctgacccgccagtgctcagtaggcaagcttgtgatgaattcaaacactttccagttccccacctccaatggcagccagggtctccagactgtttaagcactccaagcttcttccaagaatttcttctagccgactgcataacacctgagccccctccagttccacctgcagagtttggtctctctcagagcttattaaacatgcctcacagaaggaaaatggattagctatcaactgtagtgagtccatatttgcttccaaagaaccatcaatgccattttgagccacacgattttgtaaagtaattattctccaggacacaataaatgaatgtagtctttgtgtggctttcgtgttcactgctgatagattagtaaggaccattgctttttttaaaagcttaccccttatgctagattctgggccaatttcacataaaattatagctcctaagacttatttcacacccctatagcccaaacaagagaaatttcattatttggctaaaagcttttgtttctgaaaaactaaaacccaggacaaactaaatataaactggagcaagactgagccaagtagaaccactactgaagatatttgttttctcatttgttatcaaacttgacggtgggatggtgtgctgaaaaggaatctggttcataaaaactaaagctccagaggttctttaaaaggtaatacaatcaactggtcctatcatacctttcctctgccttcattttcctggtagaaagaaaacatttttaaagcccaacaataaattacaagaaactgaatagcaaataataataataataataattgaaaaagaggaaaaagagctagtaggggaggcaaaatgagaaaaaaaaatgaagagaatagaaaatgatccagagaggtatcatatatgtgaccaaaaatcaagaggtagaagaaaatgtattcatcatgatagttatcggcggtcccaggatgatattagccatcccaattattatattttctttgatgatattaaatgaatatcagagcccattatagccttacttttttttttttttttttttttttgagatggagtctttctctgtcacccagaatggagtgcagtggtgcgatctcggctcactgcaacctctgcctcccaggttcaagtgattctcctgcctcagcctcccgagtagctgggactacaggcgtgcactaactcacccagctaatttttatatttttagtagagacagggtatagccttatgtttgtaatagaacagcctttaacaggacatggatcacagaaaagaaatgaacatacattgagtgcttagtatatacaaggcattgttttagacaccaaagctgtcttcttatttaatctctgcaatagctgtatgaaacaggcactattcccgacttaagattttgacactgaggctcagagcaattcataaaacaaatgacaaagtgggtggccctggtaattgtccctgttttttctcccctcttcagtatcataagcatctgcacttaatgaagaataaaaggcataaaaagaatacaatagtaaaagaaataaaaatttcaataaagaataaaagaaaaaacagccactctcttacctctctggatgggcatggaacttcaccagactgctatagagctgtctctctgcttgtaaggcctcattgagccgactccgttcatctactagtccttctagcatcagcagcaactgagaaaagaagagagaagaagcaatacgcaaatggcacagtgagacatgaaaccacagttaatcctgagaaacaagaaaatgcattagcatgtactatgacttaaaaagcccactatcttagtacttaagcttttgatactattttatggtttttgaatcagtgtcatattatcttttttttaatctttaaaacctgtaaggtagaattcaaacatgggagcaaaaagaagaaaaaggagagaagctagaagcacaggaaagcagctaagagaaaagagtaagagggaaacaggacaagcaagagggaaatgtatgtaataggacttactagtattcttcattcattcaattaatatttactgagcaccttctatgggacagactctgttctaggttctagggggaagcttactatctaggggaggaaaaagacattcattaatcatagatttgtgtcattgtgagtgtaataagtgctataaaggtaatgagctatgataatgtataaccagagttgtttaaggtagagttaaaagccagaatggagtggggtgagtagttagtgagagagatgagtcttttggaaaagtctggcattgaagaaaagttaaacggggctgtagctacaaagaaatttggggcaaatgtaggggtttctttctctttcttttttttttttgactgggagagatttgaacatggttaaatgcagataaaagagaaagattcagttgagagggaggtgacttaggtatgagtgtgaggataactattggtatgtgtccaaaagaactgctgctcttttcagaactacaaatgtcagaaaggggcatctatagctgctaccgaccaaagtaagaaacttcagagcacagtttctctctgaaataccatcaactaaccctccacaaatagctgagattgacagctttaccatggtttatttcacagtagaaaaattaagtttgagccaggcatggtggtgtgcacctgcagctccagctactcaggaggctgaggcaggaagattccttgagccccagagtttgaggctgcagtaagctatgatcgtaccactgcactccagcctgggtgacacagtgagaccctgtctcaatgtggtgactcatgcctgtatgtaattccagcactttgaggggctgaggaggacagctcacttgcagtcaagagttcaagactagcctgatcaacatggtgaaactccatctctactaaaaaaaaaaaaaaatacaaaaaaagtaaataaataaataaggtttatattccaataacttacctgttgtctttggtttcctgaaatttcttgaccctgggattctactgaagcaactttttcccaaagaagtaagacttcctgggtcaggcgtttcatagctcttatgtcttcaggatcaaccagttgcatttgcaggtcctagaagtcaaaaaataagtgtggatgtgaaaatagtaataaaaggattattcagcagaggggagcatgggaacaaatgttcttgaaatattctgcctatactttcaagtgggatatggataatcactggccaagggagtcaatgtgtgcaaatattgtctgaagaggccctacaagtattctgagctgtgaacatttccagtggtctttaaaaagttttgaaagacctttatgagatcttctttccatatcagcagcctgcacctgcagctcttcttcctgcacagccatcatggactgtagagcagaaagttccatctgtgaaaagaggaaacaatgtctgccatgtttacattttaacactgaggcaaatgcttttgcatatcatatcactatcagccagtaatgcaaaagaaaacgagaacatgaatagggctctacagcatcaaatcaataatccatgcagtatggtaacaaaggatgttttatgggaagatgtcatagttgttcttaatgatgtcttccactttagctggcactatgaaacacatcaaatttgtttaacaagcttattatgatactgaaaaagaatggtcaccattagcagaagcaagaagagatgaagtttttatgtatttcacctaacaaatgaaaacaatgatagcattaggatatctccattttgcaacccttaatgaattaatggataaggcatcaaacagcaacagctgctaacatcacaagagatcaccaaacattacatgcctcctgatggaagaacacgccaccacctatgaagaaatattgccaaaagctggcactacatgccctaaactttcagtgttctcaccagaaaatgacaagtacttggttatgacaaagttcattaaaaatcatgataataggcagggcgcggtggctcatgcctgtaatgccagcactttgggagactgaggtgggcagatcacgaggtcaggagttcgagaccaacctgaccaacatggtgaaacccatctctactaaaaatacaaaaattagccaggtgtgttggtgtgtgtctgtaatcctagctactcaggaggctgaggcaagagaatcacttgaacccgggaggcagaggttgcagtgagccaagatcacgccactgcactccagcctggcaacagagcaagactccgtctcaaaaaaaaaaaaatcttgataataaccatagctgctaacacttactatgccccgggtgctctaataaatgttttgtgtatatttaatccttttaacaaacctagtgatctggctcctgcctacttttcctactttgatatctgccattttactgctcactcatgactctgtaggcacactagactttttctgttccaggaacaccagactttctcttgactcggcctttacaactactactccctttgcctgaaatatctttcccagggctgcctccttttcatcctcaggtcccagcttacatgtcgtctgctcagagaagccttctttggccaccctatttaagatggtctccatccatgttgctttctaccatttccctcatatcacttactatactctataattataatgtttatttattgtctgtatctccccaggagaaattaactacatacagccagagaccttactgatttcattcactacctcatccccagcactagcccaagcttagagaaggtccccatatagctaatgaatgaatgagtgaatcctcacaaaaatcctatgagataactactctttgatttatacataaggtgatttcttctactcttcaatttacagacaaggtgattgagtctgagggaaattaaggagcttgttcaaaaatcacagggctggctagtaagtggtaaatccagaatgtgaactcagggaagctgacacagagccactaggctataatgtctttcctgtagataccatatatccatacaatctttatggtaaggacaaattattttaaataaaccctttaaaggaatttagcaatagctaaatatcactcactcaaaatatctattcataggcattacaatttcatgatcctgaaaacaggacagaatcaaaaagtaacattactctggatttgataaatgtgagaaaaacaggaagaggatgtggaaactaaaatatctgacatgaataatcagataacggctaaggtagaaccacaaaaaggaagggagactaggggatttttaaaactggtatttcttaaatgccacacattctcatatcctgaaaactaattgagttgaaaaacatgagtctgttagtaagcagaaatatggtaatgaaatcaaaagataaaatatgataattccatcacaaatagaaacacaggttttatattacagatctagctatggcaaaaggtaaaaaaaaaaaactaagagctatttggactagctagctaaactgagtttaggaagccatgacactgactgatcttctaaaagagatgccaacatagtaacaaataagcttttagtttcagtctgtaactctgcgctgtggtcctagtatttcttcaacatcatacttgaatatgcaactagctgtggaggaaaggcagggggaagggaatctctaaggctgaaaggcctcttctaaaaaaattgaagagaactctatgctagagcgagttaaagcataaggtgggaaaaatgtgctctaggaaatgaatcttcttaggaagtatgtgaagtcacaaaaggcttgagtttgaatcataactctggcatttattagttacctgactattttccactcccattttaaaagagaaatcagtgtttcaacttcttcgtctataataattgggccgacaccacttactttgtgtagagttgtgagcattagtgctaatttaaatacctagcacagtacattgcacatgagtactcaataaacattgattatactcaaatttctcgtttcatgtttctaaaactgatttcatgggtctaatgtcataactctaagcagcaatcacacaacacttccttttttcactagtgctttacaattattattattattattattatcttggaggcggagttttgctcttgttgcccaggctggagtgtgatggcacgatctcagctcactgcaacctccacctcccaggttcaagcgattctcctgcctgaggctcccaagtagctgggattacaggtacccgccactacacctggctaatttttgtatttttagtagagacggggtttcgtcatattggccaggctggtcttgaacttctgacctcaagtgatccgcccacctcgacctcccaaagtgctgggattacaggcatgagccactgcacccggcccttacaattattttattccagttagcaatcgggagagagggttacgtttttccagcacttaataagttttaatggtcccaatctaaaaacaggagcatctttttgagataatgtatatataaaataacttatctccaaaaagaaaaaagtcatacctggcatttggactcagatattatacttggagaattatatgcttttaaatataaactattttgaaagaaaaaataatagggatttagaaattaagacttgactagaaaactcacctgactttctctttctttgttagccatgagttcaagttccactttggcattactcagttctttgtccagccctacaactgtgtccaagtctcctaaaatgaaaatatagcactagttttcattgttattaacataatgtgatatttgctgcctcctttgagtaatttatagaggacacattccaataataagaaaaaagaaaacatacacagattgttctttgtagcattatttatcatagcaaaatactgcaatcatcctagatgctataaagaaaagattgaataaactatagtatattcacagatggcactatatactgctgtaaaaaaagaataaggatgatctttatgaacttttatggactgattttgagattctaagaatatgttaagtaaaacaagctatgtgcttaagaatacatctaaggtagtaggttttatattaggaaaaaggggaaataagaatatatatatatacatcacatatacacagatgattcatttgcttatttttgcaaaaagatatacaggaagaataacccagaaatgaaactgattacctgaaggagatgagtggaaacaggagagaagggatagggaaatatgggacatctgagtatattgttttatatactggagttttgaactgtgtaaatgtttaatttttaagtgtaagtcagcttgacaatgaatgggagagaaaatgtctagaattgaatactaatataaataaataaagctatatagcaaatagataatgaaactacccagaagataataaaaaaattaatccaaataatttttgaactcactactctaactgaacactgtcagtgcaaaatatcctaaggataaaaagaattacaaaaaaatcttaaatattacttaatactttattgttgatggtggtatttatgtagcaattctgaaactacctttgcatactatagtattctgcaaatgtgtaaatattttgaaacatattgatgctataagtaaccagggctctcaaggagatacaaatatgaaatgagggaaagaagaacctatattgttaaattggaattacagaaatcagtatcaaatcttcattatgtatacaaatacgcacaaacatacttaaaaatattcattgctagctctgttctcttaaaagggcctagaagcaaaaggcattcatgtagcaatgaacacatcttgtgtccagatcatagtttctgaatgccattacccaccaaaaggaaccagggagctctttaagataatggctgattctgggactgaggcaggtaaagcaaaaggtaatcatagaacatcttattgtgccagaaactatcaaactatgctaaaaaaaaaaactgatggggatatggcaaaggctcagagaaacagcttgatgaggctcccactgaccaaatatgggttaatttgagcattaaaggaaataatgaccaaaatcaataatataatgatttttaaaactccatattgataaaaacaaatggggtatagagataaggaaaggacagctcttctttataaataatacccacaaataaacaaagaagaaattttacaaacagaaaatcataatttctttttttttttttttttttttttttgagactgagtcttgctctgtcctccaggctggagtgcagtggggcaatctctcctctttccaggttcaagcgattctcctgcctcagcctcctgagtagctgggattataggcatgcaccatcaagcccgactaatttttgtattttatagtagagacagggtttcaccatgttggccaggctggtctcaaactcctgagctcaagtgatctgcccgcctcagcctcccaaagtgctgggatataggcatgagccaccgcgcccaaccctgaaaatcactatttttaaactaccaacgtagtttacattcagccagcagatcacttatatactaaaggggaaataaaccttttacaatggagagatttggcagctacaaccttaactaaatgactaaatttaatatcaccaaggatgacacaaactgattatcatgcaatgacgtgtggcaccaaaaaagatgtcatccaggccatgcgcggtggctcactcttgtaatgccagcactttagaaggctgaggtaggtggatcacttgaggctaggagttccagaccagcctggccaacatggcaaaaccctgtctctaagaaaaaatacaaaaaaactagccaggcatggtggcgcatgcctgtagtcccagctacttgggaggctgaggcgggaagattgcttgaaaccgagaggcaggcaggcagccacgcaggacggaaggaaggaagggagggagggagggaggaaggaaggaaggaaggaaggaaggaaggaaggagggaaggaaggaagtcacccatatggtattcctgccaaaaatgtttaactcgaatctaaccatgaggaaacaatcacagctaaattgaggaatattatctggcctggattcttcaaaatgccaatctcggcctctgcccccgggcgggccgggcggcagtggtcgggggagccaggctgagggtgggggtgggtggccggcgggcggtgggcggggagggcagcggaggaggcgaggagcgccgggtaccaggccgggggaggcgcgggctcccggggaagagacgggtgatgaacaatctttacatcgggaaccttagccctgcggtcaccgccgacgacctctggcagctctttggggacaggaagctgccccccaccggacaggtcctgctcaagtccggctatgccttcgtggactacccctacaagaactgggccatccgcgccatcgagaccctctcgggtaaagtggaattgcatgggaaaatcatggaagttgattactcagtctctaaaaagctaaggaggagaaaaattcagattcgaaacatccctcctcacctccagtgggaggtgttggatggacttttggctcaatatggaacagtggagaatgtggaacaacaagtcaacacagacacagaaaccactgttgtcaacgtcacatatgcaacaagagaagaaaatagacatggagaggctaagcgggcatcagtttgagaactagtccttcaagatttcctacatcccggatgaagaggtgagctccccttcgccccctcagcgagcccagcgtggggaccactcttcccggggagcaaggccacgaccctgggggcgcttcttaggccagacagattgatttcctgctgcaggtcctggtcccctacagtttgcagtttgttggtgccatcatcagaaaggagggcttgaccataaagaacatcactaagtagacccagtcccggatagatatccatagaaaagagaactctggagctgcagagaagcctgtcaccatccatgccaccccaggggggacttctgaagcatgcctcatgattcttgaaatcatgcagaaagaggcagatgagaacaaactagccgaagagattcctctgaaaatcttggcccacaatggcttggttggaaaagaaggcagaaatttgaagaaaattgaacatgaaacagggaccaagatagcaatctcatctttgcaggatttgagcataaataaccaggaaagaatcatcactgtgaagggcacagtttgaggcctgtgccagtgctgagatagagattatgaagaagctgcgtgagacctttgaaaatgatatgttggctgttaatacgcactccggatacttctccagcttgtacccccatcaccaggttggcccgttcccgcatcatcactcttatccagagcaggaggttgtgaatctcttcatcccaacccaggctgtgggcgccattatcaggaagaggggagcacacatcaaacagctggcgagattcgccacagcctccatcaagatcgcccttgcggaaggcccagacgtcaacgaaaggatggtcatcatcacccggccaccggaagcccagttcaaggcccagggacggatctttgggaaactgaaagaagaaaacttctttaaccccaaagaagaagtgaagctggaagcccgtatcagagtgccctcttccacagctggccgggtgattggcaaaggtgtcaataccttgaatgaactgcagaacttaaccagtgcagaagtcatcgtgcctcgtgaccaaaggccagatgaaaatgaggaagtgatcgtcagaattattggacacttctttgctaccccaactgcatagcacaagatcagggaaactgtacaacaggtgaagcagcaagagcagaaataccctcagggagtcgcctcacagcacagcaagtgaggctcccacaggcaccagcaaaacaacggatgaatggagcccttccaacacctgacagaatgagaccaaacacagccagccagatcgggagcaaaccaaagaccatctgaggaatgagaagtctgcggaggctgccacggactctgaagaggccctgagaattccaggggccgaggaggggtggggaaggtcagccaggtttgccagaaccactgggcccgcttctcacccccatcagggcttctgcaggcttcagccatccacttcaccatccactccgatctctccttaactcccacgacgctatcccttttagttgaactaacatagtgatgcgttcaaagccaagcaaaatgcacaccctttttttgtgacaagtcatctctgtacatgtgtatacatattagaagggaaagatgttaagatatgtggcctgtgggttacacagggtgcctgcagcagtaatatattttagaaataatatatcaaataactcatctacaatttttaatcaatcattaattttttttctttttaaagagaaagcaggcttttctagactttaaaagaataaagtctttctttgggaggtctcacagtatagacaggagctttgaggccacccacacaaaattcacccagagggaaatctcaaaggaaggacaatcacagcagttctggatcacctgtgtatgtcaacagaagggataccatctccttgaagaagaaactctgtcactcctcatgcctgtctagctcttacacccatttctctttgcttcacaggttttaaactggatttttgcatactgctatataattatccatctctctctgtttatctctcccctccctcccctccccgtcttcttcatctccattcttttgaattccctcatccctccatctcaatcccgtatctatgcacctcactccctcacagggaaagcagtgctctgagtatcgcatcacacgaaaggaacaaaagtgaaacacacaaaccaacctcaatttacacttggttactcaaaagaacaagagtcaatggtacatgtcctagcgttttggaagaggaaaacaggaacccatcaaaccaaccaatcaaccaaacaaagaaaaaattccacaatgaaagaaggtgttttgtcttttttgcattttggtgtataagccatcaatattcagcaaaatgatttctttctttaaaaaaaatgtggaggaaagtagaaatttaccaaggttgctggcccagggcattaaatttacagatttttttaatgggaaaaacacacagaaaaagctgcctcaggtgttttttacctcagcaccttgctcttgtgtttcccttagagattttgtaaaactgatagttggagcattttttaattttttttaataaaaattagttggaaaaaaaataagatatcaactgccagcctggagaaggtgacagtccaagtgtgcaacagctgttctgaattgtcttctgctagccaagaacctatatggccttcttttggacaaaccttgaaaatgtttatttaaaaaaaaaaagatgacaaagaaaaacagacagagataatattggagatgtcctgaattttaatagggtatgcgccattaggactttttgtgctaaaggatgaacatgtactgttttatgtgaataagccattataccaccagactgcaatgccagtttcctctattgcaaacagtgttctgtgacaaaaaaaaaaagaaagaaaagaaatatatccagctaacaagaaaaaaaatgcaaatctcactaaagaaaaaaaaaagctagacaattgttctagattagagactaagagacatgacaactaagcacaatgcataacccctgggttgggggaaaccaaagtagctatacagaacattatggggacaacaggaactctgaatgtggactgtatattagatacgaagcctatatcaaggttaaattttctgagtgtgataattatattgtagctatgtaggagaatgcccttgttcttaggcaatacttactgaagtatttaggaataaaatgtcatgatttctgtaagaaattccccagtggttcagaaaatacattacaactacatatgtgtgtgtaatagaaagaaaaaaggcaaatgtggcagaatgttaataactggtaagtctgaataaaaatgtatatgagtattcactatactatttttgccactttcctgtaggtttgaaatttccaaaatcaaaaactttagggaaaagtacacttttttaaaaaggcaaataaagaataaataaaacaaatccaacattcttttactctttgattagtgtaaagctttcttgctagagaatgactacttgtaaggcttttctaaaccatcccctgaatggggctaggcttggcaaataactcaatgtacaccacctacccttcctaacagtttcatgtaggtgacgtcaagttacagtgagtggccccagacttgaaagatacccggaaaaaagtcagctcatggctctgctgtgcaggattggaacctcctgcatttctgaatccctgcaaagctatctgaaaaggagaataatgatagagtttctctggccaaattgtgaacccagagcaataacctcaactcaacataaggtaagtacagttcttcagcctttcagaggaattccaaacttgtttgttccattaaggtaggaagagaaaagagtcttggccaaacctattaatacggagattactagaaggaaaaacaagagaaaaacaaagtcccttaatgaaatgaaatttgatacttatctaatgtgcatctgggtatgctggcatcctctttggcagtcgatgaagtgctatcatctctggaaggtatctgcattgaaccctaaaaaattggaaaagtcgggggacttaggaagatgcaggaactatgaccacaatgacagtactgagaatattctcagaatttggtattaaaattatcaaacttacacctcaaatgtaaaaagaaaatggaatcagcatgaattatctaagtccatagttcttacttgatcagtctgttctccaagagtgggggccaatggaggtaacttcagcttgctggttagagatgggtgcttgggacattagggagtctctccctcctaaatattggtgcagggcctgtaattctgaatttctttccattaaggcttgcaccatattctctcttctcgaaaaaaaaaaagaatttacttcttaaatattgtgaaattaatataccccatactattatgagattgtttactctcaccatgacctctgaaaaatgcaatcttttttccctcttaagataactcagattttacaaaaactaagagtaaacatgttgagtgtaagttttcccataccttgactggaaatgcaaaatatcactcaagtcttaataatttagaatcaaaaccaaaacactcacaacccctactcctttctctcaaaatgatcagattattaaggaaaagaaaatgtatgtaatgaagttaatggatacatgtattgtttaggcacccttccaaatgcaaggttttcaagaaatgtttcatactttgatgattaatgtaaaactgtggtctaaggccaggtgcaacagctcacacctataatcccagcactttgggaagccaaggcaggatgattgcttgagcccaggagttcaagaccagcctgcgcaacacagcgagacccccacctctaaataaataaataaataaaactgtggtctaggtaataaatagaaggaaagaaactaacagagttgactgtaaaatatataaatatacatgcatctatagtctgcaaatgcttcctatttgcagactataaatgcactatgtgatacttttctgatctgtgcattaatccttacttggctttcctgctccccggtgcgcatagaccaaagcaggccttgaatctccatttcatcttctaccacttctttgttttgatcacttagaaggtcctgcagcatcctttcctttcgctgtagacgctggcacagctcctctgctatctcactctgccctggtccaagtttgcagagcaatgttgcactaagatcctaatgcagaaaggacactgtaagtttctggaggaaagaactgcctctactaaatatcaaagggcttataagaatctatcatagaagaaggagtgtgagatacttgagaataagtatcatgttttactcatttttgttttaccagatctagcacaagcctggaacacagaagtctctaaatacatgtcccaggaatgaatacaaacaatacagaaaactgtctttagtggccacttacatacatattgttttctgaaataagtctttttcctatttgttcagggcatgtaacaattaatgttagatgaggataaatggacactcagttcatttatttgttttctccccagtgtaactttatagggataagcataaaatgataagctgaaaggaatactaaacactatgtttgctatcatagtgatggtttctatttctgtactaaccgacggcacacggtggaggaaacggaggagctatactgcctaggttgatactggatctgctacttattagctatgttagcttgggcaagttacttagctttagacatctgtttcctcctctataaaacagggataatagaatgtgcccatgaacttgtggggattcaatgagttaatatccattaagatcttaaaacagtacctgacccagcatgaacactgtaactaataaaggttagctatcatattaaagatgcaatttttaggtctcattaattctcacataacttctttgagaaagttaattgccaacttaagcttctagatgtgggggaaaaaaaatcccagtgaaagtaaattacttgcccaggcacagaatcacttgtacctggagaatcgcttgtacctgggaggcggaggttgcagtgagctgagatcacaccattgcactccagcctgggcaacaagagcgaaactccatcccaaaaaataaaataaaataaaagaatatcaagcagccaaagaagcaaggaaacatgatacataatgaagaatctaataatctagttgaaattgacacacatgttggaaatagcagaaaaggacattagagcagttataactgtattttaattaaatggagagattgaagattttttaaatataagattctgtagataaaaactatgatttacagtctgaaatggaagaaggcactggattaaacattgcagaagagaagattattgagctagaaggaatagaagttgaaactaacataaatgaaacccacagtaacaaatgactggaaaacataaaaggactatcagcataaaaactgtaaacaccctagtatagggctaaatggaatccctgaagggtgtgtagtggagaagagagacaaaaatatttaaaacataccggatgaaagattaaagagcttcatggaaaccataaacttcaaatattacagaaatatgattattctaagaacaagaaacatgaagaaaacttaaccaggaacatcttaatcaaatccatcaaaaccagtgataaagaggaagttttaaaagtaataaaaggggaaagaacatgttacatacagaggactaaatataaggatggcataagatttctcataggaaacttgacaaacaagaagtttgcaatagttttaaagtaattaaaaaaagaaaaactgttgcctacaattctacacctggccaaattatctttcaaaaataaacatgagaaaaaatatttttgaaaagaaaacaaaattatctcaatttgcagatgatgtgatcctatatatggaaaatcccaaataatacaaatgcaaacacacatacatgcacatagacaccagacacacacacacacacacacacacacacacacacacactctgctagagttagtaagctaattcagcaaactttcagcaaacaatcacttgtgttagcaatgaacaatctgagaagaaaattgacacaacgattacatttataatagcactggtaagaataatatgcctgggaataaatttgttcaagaaggtgcagtacttgtacacagacaactacagaacattgctcatggagattaagaaggacctaaataaatggaaagacatattttgtccatgggttggaagttgtaacatggttaagataaaaatacaactcaaagccatccacagattcaatacaatcctatcaaaaagtggccttttttacaagaatggctaagaagaacttcatattcctaaaaaatagtgtgtcccctcaaaacaaaagcaatcttgaaacgcaaggaggaacattttctattccaaaggtctttaactgctctcagcaatacttggtagtcttcaatatacaggctttcacattttttttcttttgtttctaggcaggatctcactctttcacccagcctggagtacagtggcatgatcacagctcactgcagcatggaattctcaggcctatgacatcctagagcctcatccactgagttcctgggactacagactcacaccaccacacctggataatttttctgattttcagtagagatgagggctcactatgttgcctaggctagtttcaagcatctgagctcaagcgactctcctgccacggccttccaaagtgttggtatttgaagctgagcctggctggctttcacatgttttctatgtagttgatatttcttgatactattgtgagcctggctggcttttacatctttgctatgtagtgaaaccctgtctctaccaaaaagacaaaaagaaagagagagagaaagaaagaaagaaagaaagaaagaaagaaagaaagaaagaaagagaaagaaagaaaagaaaattaaagaagagaaaatctctgaactaaacttattcctcaaactctgaccttacaaatcttatgtgcccatctcttctgcctagaggaagaggggggcatgaggcagaagagaggtgcatgtgggattgttgggcctagatggattgaatggtttcaatttctgcttttgtgtctcatgaaagcagttcattttggttgtcatcttctccaggttctgaagacgaggcattgattggcatcaatgttcaagatttagcaagagtaggtgccttttttcagacccaggagtcaaagccctgtaagctaaaagcacagggatcagttaataggatgttggtactgcaggaagtcctatttctctctaacatgtcacaaatgaaaacactgtgatttggtgtccagtagttactgcctgaagcacttcaaaccattgtattaaagcggttaggatactccttgcatgtacctaattgccagcattctaatcacagaaccatgaccaaaagcatcaaaaatgtgacagggcctatgccaaacttatcaaagtaagacaattgacatttctctctatcatttaacaaaatggtaaatgcaaagaacagttttggaaatttactatggggataaataatctccttttctttaaacaccatacaacaaaacaaggacaaagtgagaataaacacacagtaattttttcagctatgttatttatttatttatttagagacaaagtttccctctgttgtccaggctgtagtgcagtagcaggatcttggctcactgcaacttctacccccacctaccaggttcaagtgattctcatgcttcagcctcccaagtagctgggattacaggtgtgcaccaccaaccccagcaaatttttgtatttttagtagagacagcgtttggtagtgttggccaggctggtctcaaaatcctggcttcaggtgatctacccaccttggccgcccaaaatgctgggattacaggcatgagccaccacaccgggccctcttttcagctattttaaaagagcataaccacatatttccaagattggtttctactgattactgattaggtcactttcaccactaaaatcttcaaaccagtgcaatatttgtacatgttttgttttcaagtacacacatgaaggcctaacagtgatacaaggcttgggttcaaaaatcactagaaagtctcacatcatttttttcatcaccacttaatccaagtgaatgtcgcttaattttaataatggtaaaaacaactagattgagagaaatcccaattcatataatttcctaaaggacaaggccaatctgtcccgaacatggaaactttgtacccatatcagagcttttcttcattaaaggaaaggatctgcaaccaattcaaatgattggtcaaaaccaactgaagttactgattgcattgaatgtgtaccaaacctcaggccatgggtgcctgagtcctagtgttcctgtgacatccctttggggtggtggaactctacctttcaatgatgggaagtcttgggaaagagcaactctcctctccttgtctagtataggtagcttttgtgtcaaactctactcagcaggtgacctatacctgggaccaagggtaagaagggttccttcctccaacatcagtggcagatgccttttgtttcatgtgagagaagcaaccaggttttgtgcctgtactttggtggtggccaatcatgacctatatgcctataccactgagggaagctcaagaaattctcttttgcctccctctctctctctctctctctctctccccctctccctctccctctccctcaccctctccctctccctctccctctccctctccctctccctctccctctttgtacagtctccctctgatgctgagctgaggctggactactgccgccatctcgactcactgcaacctccctgcctgattctcctgcctcagcctgccaagtgcctgggattgcaggtgcgcaccgccacgcctgactggttttcgtattttttggtggagatggggtttagccgtgttggccgggctggtctccagctcctgaccgcgagtgatctgccagcctcagcctcccgagttgccgggattgcaaatggagtcttgctcactcagtgctcaatgttgcccaggctggagtgcagtggcgtgatctcggctcgctacaacctccacctcccagccgcctgccttggcctctcaaagtgccgagattgcagcctctgcccggccgccaccccgtctaggaagtcaggagcgtctctgcctggccgcccatcgtctgggatgtgaggagcccctctgcccggccgcccactctgggaagtgaggagcgcctcttcccggctgtcatcccctctaggaagtgaggagcgtctctgcccggccgcccatcatctgggatgtggggagcgcctctgccctgccgccccgtctgagatgtgaagagtgcctctgcctggctgcaaccccatctgggaactgaggagtgtctctgccctgcagccaccccgtctgggaggtgaggagcgtctctgaccggccgccccatctgagaagtgaggagcccctccgcccggcagccaccccgtctgagaagtgaggagcccctccacctggcagctgccccgtctgggaagtgaggagtgtctccgccctgccagccgccccgtccgggaggtggggggcagcccccgcccggccagctgtggcgtctgggaggtggggggcacctctgcctggccgccccgtctgggaagtgaggagcccctctgccccaccgccaccccatctgggaggtgtacccaataactcattgagaaagggccatgatgacgatggcggttttgtcgaatagaaaagggggaaatgtggggaaaagaaagagagatcagattgtcactgtgtctgtgtagaaagaagtagacataggagactccattttgttctgtactaagaaaaattcttctgccttgggatcctgttgatctgtgaccttacccccaaccccatgctctctgaaacatgtgctgtgtccactaagggttaaatggattaagggaggtgcaagatgtgctttattaaacagatgcttgaaggcagcatgctccttaagagtcatcaccactccctaatctcaagtacccagggacacaaacactgtggaaggcggcagggccctctgcctaggaaaaccagagacctttgttcacatgtttatctgctgaccttccctccactattgtcctatgaccctgccaaatccccctctccgagaaacacccaagaatgatcaataaatactaaaaaaattaaagaaaaaaaagaaagaatgaacatatccttaacaggggcttgattaaaataagaaataaaaggatgtatctctataatgaaaataaataaataaataaataaaataaataaaaagacatgacaactaaaaaccctctcaattaccttctctcctcctttcccttccttccttccttcgttcttctctccctccctctttccattcttctccatttacaaaaaaataaaaaaataaaaaataaaaaaaataaaaagattatcttcaaaaaacaaaacaaaacaaaaaaagaaattctctttccctgcgacatgtttcttgttagcactcaggaaatgtgggaggaaaaaacttggcaaatgggcaaaaacatgctacatatctgggactcacatagattctgtcacaatagttcacacttgacctttaagaaatgatgaaaacttcagtgattttctccaatcaacatttatggctgccatatttttcttccattatctggaaggaaactgcttcatttgtttgtccttctttggtgggggttctcatgctttggacttcagttgatctagtggccttcaaacttcacctctctggtgggatcaaaacaaatatgattttgcagaccagacagctttctcttgtcattagagtggaacaactgtctctttcagctttctatgtcgtaaacaactgtagaatctattttataaattctttatcttctctatttctagactaatttctcttcaggatagtacacaaattctgttagctgatcactttttttgaggctatgagatagaaataatgagcaccttgaagatccctgcaaaggagcatattcatttggtgctcaagggaaacctgggcccagacccgtactgaaactcataactgtcacccacagctctagttaaatttttttttttttttttttgagatggagtctcactctgtcacccaggctggagtacagtggtgtgatctaggctcactgcaagctccaccacctgggttcacgctagctctagttaaatttttacaatgaggctacctcttctcaataagcatactagtcttaaaacaagtttgagatagggactatcttaaaataggcttcccggaggctggagccaagatagccaaataggaacagctccggtttacagctcccagcgtgagcgtcacagaagatgggtgatttctgcatttccatctgaggtattgggttcaactcactagggagtgccagacagtgggtgtaggacagtgagtgcagcacactgtgaacgaggtggagcagggcgaggcactgcctcatttgggaagtgcaaggggtcagggagatcactttcctagtcaaagaaaggggtgacagacggcacctggaaaatcgggtcactcccaccctaatactgagcttttccaatgggcttaaaaaatggcacaccaggagattgtatcctgcacctggctcagagggtcctacacccacagagtctcactgattgctagcacagcagtctgagatcaaactgcaatgcagcaacaaggctgggggaggggcgcctgccattgcccaggcttgattaggtaaacaaagcaactgggaagcttgaactggatggagcccaccacagctcaaggaggcctgcctgcctctgtaggctccacctctgggggcagggcacagacaaacataaagacagcagtaactcctgcagacttaaatgtccctgtctgacagctttgaagagagtagtggttctcccagcacacagctggagatctgagaatgggcagactgcctcctcaagtgggtccctgacccccgagcagcctaactgggaggcaccccccagtaggggcagactgacacctcacacggccaggtactcctctgagaaaaaacttccagaggaatgatcaggcagcagcatttgtggttcaccaagatccactgttctacagccaccgctgttctgcagccaccgctgctgatacccaggcaaacagggtctggagtggacctctagcaaactccaacagacctgcagctgagggtcatgtctgttagaaggaaaactaacaaacggaaaggacatccacaccaaaaacccttctgtatgtcaccataatcaaagaccaaaagtagataaaaccacaaagatggggaaaaaacagaacagaaaaactggaaactctaaaaagcagagtgcctctcctcctccaaaggaatgcacctcctcaccagcaacagaacaaagctggatggagaatgactttgacgagtcgagagaaggctccaaatgatcaaactactctgaactacaggaggaaattcaaaccaatggcaaacaagtttaaaactgtgaaaaaaaattagacgaatggataactagaataaccaatgcagataagtccttaaaggagctgatggagctgaaagccaaggctccagaactacatgaagaatgcagaagccccaggagctaatgtgatcaactggaagaaagggtatcagcgacgcaagatgaaatgaatgaaatgaagtgagaagggaagtttagagaaaaaagaataaaaagaaatgaacaaagcctcccagaaatatgggactatgtgaaaagaccaaatctatgtctgattggtgtacctaaaagtgacggggagaatggaaacattttggaaaacactctgcaggatattatccaggagaacttccccaatctagcaaggcaggccaacattcagattcaggaaatacagagaatgccacaaagatactcctcgagaagggcaactccaagacacataattgtcagattcaccaaagttgaaatgaaggaaaaaatgttaagggcagccagagagaaaggtcaggttacccacaaagggaagcccgtcagactaacggcggatctctcgggagaaactctacaagccaaagagagtgggagccaatattcaacattcttcaagaaaataattttcaacccagaatttcatatccagccaaactaagcttcataagtgaaggagacataaaatactttacagacaagcaaatgctgagagattttgtcaccaccaggcctgccctaaaagagctcctgaaggaagcactaaacatggaaaggaacaaccagtaccagccactgcaaaaacatggcaaaatgtaaagaccatcaaggctaggaagaaactgcatcaactaacgagcaaaataacgagctaacatcataatcaccagacaaaattcacatgtaacaatattaactttaaatgtaaatgggctaaatgctacaattaaaagacacagactggcaaattggataaagagtgaagacccctcagtgtgctgtattcaggaaccccttctcacatgcagagacacacataggctcaaaataaagggatggaggaagatctaccaagcaaatggaaaacaaaaaaaggcaggggttgcaatcctagtctctgataaaacagactttaaaccaacaaagatcaaaagagacaaagaagaccattaaataatggtaaagggattaattcaacaagaagacctaactatcctaaatatatatgcacccaatacaggagcacccagattcataaagaaagtccatagtgacctacaaagagacttagactcccacacaataaaataggagactttaacaccccactgtcaacattagacagatcaatgagacagaaagttaacaaggatacccgggaattgaactcagctctgcaccaagcagacctaatagacatctacagaactctccaccccaaatcaacagaatatacatttttttagcaccacaccacacctattccaaaattgaccacatagtaggaagtaaagctctcctcagcaaatgtaaaagaagagaaattataacaaactgtttctcagaccacagtgcaatcaaactataactcaggattaagaaacccactcaaaaccgctcaactacatggaaactgaacaacctgctcctgaatgactactgggtacttaacaaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaattgagacacaaaaaacccttcaaaaaattaatgaatccaggagctggttttttgaaaagatcaacaaaatcgatagactgctagcaagactagtaaagaagaaaagagagaggaatcaaatagatgcaataaaaaatgataaaggggatatcaccaccaatcccacagaaatacaaactaccatcagagaatactacaaacacctctatgcaaataaactagaaaatctagaagaaatggataaattcctcaacacatacaccctcccaagactaaaccaggaagaagttgaatctctgaatagaccaataacaggatctgaaattgtggcaataatcaatagcttaccaaccaaaaaaagtccaggaccagatggattcacagccgaattctaccagaggtacaaggaggaactggtaccattccttctgaaactattccaatcaacagaaaaagagggaatcctccctaactcattttatgaggccagcatcatcctgatacgaaggcctggcagagacacaacaaaaatagagaattttagaccaatatccttgatgaacattgatgaaaaaatcctcaataaaatactggcaaactgaatccagcagcacatcaaaaagcttatccaccatgatcaagcgggcttcatccctgggatgcaatgctggttcaacatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatctcaaaataataagagctatctatgacaaacccacagccaatatcatactgaatgggcaaaaactggaagtattccctttgaaaactggcacaagacagggatgtcctctctcaccactgctattcaacatagtgttggaagttctggccagggcaattaggcaggagaaggaaataaagggtattcaattaggaaaagaggaagtcaaattgtccctgtttgcacatgacatgattgtatatctagaaaaccccattgtctcagcccaaaatctccttaagctgataagcaacttcagcaaagtcttaggatacaaaatcaatgtacaaaaatcacaagcattcttatacaccaataacagacaaacagagacccaaatcatgagtgaactcccattcacaattgcttcaaagagaataaaatacctaggaatccaacttacaagggatgtgaaggacctcttcaaggagaactacaaaccattgctcaaggaaataaaagaggatacaaacaaatggaagaacattccatgctcatgggtaggaagaatcaatatcgtgaaaatggccatactgcccaaggtaatttatagattcaatgtcatccccatcaagctaccaatggctttcttcacagaattgggaaaaactactttaaagttcacatggaaccaaaaaagagcctgcattgccaagtcaatcctaagcaaaaagaacaaagccagaggcgtcacgctacctgacttcaaactatactacaaggctacagtaaccaaaacagaatggtactggtaccaaaacagacatatagatcaatggaacagaacagagccctcagaaataatgccgcatatctacaaccatctgatctttgacaaacctgagaaaaacaagaaatggggaaaggattccctatttaataaatggtgctgggaaaactggctagccatatgtacaaagctgaaactggatcccttccttacaccttatacaaaagttaactcaagatggattaaagacttacatgttagacctaaaaccataaaaaacctagaagaaaacctaggcaataccattcaggacataggcatgggcaaggacttcatgtctaaaacaccaaaagccatggcaacaaaagccaaaattgacaaatgggatttaattaagctaaagagcttctgcacagcaaaagaaactaccatcagagtgaacaggaaacctacagaatgggagaaaatttttgcaaactactcatctgacaaagggctaatatccagaatctacaatgaactcaaacaaatttacaagaaaaaaacaaccccatcaaaaagtgggtgaaggatatgaacagacacttctcaaaagaagacatttatgcagccgaaaaacacatgaaaaaatgctcatcatcactggccatcagagaaatgcaaatcaaaatcacaatgagataccatctcacaccagttaggatggcgatcattaaaaagtcaggaaacaacaggtgctggagaggaagtggagaaatagaatcacttttacactgttgatgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgtggcactattcacaatagcaaagacttggaaccaacccaaatgtccaacaatgatagactggattaagaaagtgtggcatatatacaccatgaaatactatgcagccataaaaagtgaagagttcatgtcctttgtagggacatgtatgaaactggaaaccatcattctcagcaaactatcgcaaggacaaaaaaccaaacaccacatgttctcactcataggtgggaattgaacaatgggaacacatggacacaggaaggggaacatcacgcttcggggactgttgtgaggtggggggaagcaggagggatagcattaggagatatatgtaatgctaaatgacgagttaatgggtgcagcacaccaacatggcacacatatacatatgtaacaaacctgcacattgtgcacatgtaccctaaaatttaaaatataataataataaaatttaaaaaaataggcttcccaagaggctaagatttgctgcaactccagtttgtggtcaaatgcagaccagcagagtacagacggcattgttggcccaggagaaggcaaaaatacagggagatgccacattttttatcaacctcctaacaattatctcaatgaatattcaaattggtgattgaagtacttgtttctccaagcaggtgataggcaaaattggaaaagttgccttgcttgtataaataattgtgtgctcagattgaatttgagggtatacaggtgcagcctccagtggaaaatattctaagaacaggatgtgggtagaggatgcaattatggaacttcatatcttcaccacctttctcttctttcttcctattttgactagtcttgtaatcctagcctcatgcatcaatatacatacaactaagagaggcaatatcaatgcaaaagacacaatatctatacaacgaaattagatggtgcctattgctaaaggtactttaacttcacatcatatagcccaattaggtgaatgccgcccacctaccaaaggtattagtcagctcaggctgccacagaaagataacaaagttttcgtggcttaacaatagacattttctcaaagttctggaggccagaagttcttcttgagtcttttgtgaggttggatgtgctagcagggttggtttctggggaggcctctcttcctggcttgcagaaagccactttcttgctgtgtcctcccatagtctttcctctgtgcctgcgtggagaaagagattctttgatgcccttcctcctcctatatggacaccattcccaccagattaggggcccacttgtatgacctcattaacattaattaccacattaaaaaccctatctcaaaatacagtcaacttggcggttaagttttcaacatatgaactcacagggaaacacttcagtctataacatcaagcaatacagatgatcctaagatcctctacctattaagtcctgtgacatttgcctggtggtgcagccagaaataagttgttaccaaggctgctattattgctaattctatgattaggaaagcacacctgaactggtttgcctgccatataggaaagagtgcagatcaaacaggtatgaaataaaaataggggaaaatggtagcaaacaaaacagtgctcttaagtgagtcatgaatctaggaaggactgaaatcatgcaatttcaaggaaatcctattgtctttattgggagaaatgacttgccaaatttcctaaactagggagaaaagggtggtgtggattaaggtccacacctgacagttcaagataacttgagttcttggctaatcagctatatggggtgagagacagatcagcagtcaaagaaaactctaagatttctggattgagtgtacgtaaggatggagtttccatcaactgaggtgagaaaactgcaggtgctgtaggttgcaggaggaagaagagagatcagtaccaggcctcaaagcctagcttgaaagaggtttccattcccccatctccgtttctgcatctctttgagtcttttgtgaggttggatgcagaggtgttggtgtttggccacttctccccctggacatctctcttctcacctcctttgacagccacatctatggtcttgtcctgatgacatctcccagcacgatgtcgttttgcaaaggtgatctcaaaatcagctctgagctgaagccagggtgaggtcacccactccttgatttgtgtggccttggtgggccccaggagcacttcactacttctcaggggagtaggtcttttgtatggaactcttcatctgagggaagcagggagaaaatgtcctgtggggagggaagggagggctgtaccagagagcctaggtgggcagatctaggctctcaatgcaaagaacatttacaacctgagaggttctactcagttactattgttaatttaggatctcatcaacgaaaatggtatagaaatttgttttctcattggttacatgtgcacctacataataccctcggttttgcctcttggcttaaaagcctacaatatttaatagatctctctagccctttacagaaaaatgtttactgaactctgcagagaacaatcccgcatgctttacagaaagggacactcaggaatctcctttgctaatttttttgtgttagatgattttcctggcaaacaataaattccctttcttggcttgtaatgattaatctctggttggttgtcacctgcaatgaaacaatacatatgggaacctcaaagtagaaaaatcctagaagaaaacctaagaaataccattcttacttttttttttttttttgagagagagagagagagagcgaacgggttcgaaccactgacctccaaacttggaagcaagcacaccacccgactgcgacacacgaatggacagtcaactgtcgctcccgcctcaccatgcagagcacgcgcccatccaacactaggcagagccaccgccttttgtagaacaattgtgcaggctccaaagcctcagaaaaccggagaggcgcatcttgctggctacggttgaaacccgtgcattgggtgattccaaagctggaagggcagcggaatggccttagccccgtcctgcccttcgcaggcgtcagagccagcgtcccgggaaacgcccgggtccgcgacttcccaaaggaagcagaacgccccgtggactctagtgatggctctttccgttcttggctccgccttcacccgactttctacgccgcttgggctcccctagctcaactcggcttcggtcggtgcggcgggagagagaaagggtgaaaagcagaaatacagagaggcgggagagaagcagaggaggtgcggaccaggacagagagacctcctgagaaaggctggtgcagggagaccgaggctggtgcagggaggcccaggctgcagtggaggagatgagaattattctcaacctgtattaggattgggagggagggagggaggcgaaagcaaagcgggcatgaaagggagaaaaacgtgaaccccctgtggctgtctgggaacaaagccgcctaataatggaaacctattgacgtcaaaactgctagagcaaggtcaagcatcaccgcttgccttgtggcccgccgtgatcgtatagtggttagtactctgcgttgtggccgcagcaacctcggttcgaatccgagtcacggcaaagttgctcgtctgggtagtcagctgatccgttttgctccccgcaaccaggcgcgtcagggtaaggcagaaatgtattcagctacagtctcttccaataactttagggttccgtttcaatttctaaatctatggcatatcaaattcatctcctgaccagagcaagcttagcatctgctaatgtcttgatccccagaaaacttctctatagtgtaaacacactggcaagagttacttctctgctcttcgacagctaggggccctgcgcctccctccatttcttccctactcctctctcccttggtctctttctctgtccttctctctctcctctggtgcagctgagagtcccagagacacctgaaacagagaagtgggcaggtccagtctaatctatgtccaagaacccaggttctgttttggaaatctacgtcggcccttgcctgaccttggttaactatcttaaattttatgtgcctcaacaattttctatggaaggttgggccactttgagaactctgccttacactgctgttgtcagacatgcctggatttagtgactattcaatcaataacataatcactagaattataaaaatcattgtcattgtcttctgccttatttgtgaacaatcactctcctgattgttttcactttacctttgcttctagaacttcatgcagatggaatcatggtgcatctactctgttctacatgcttctttctctctgcataatgtctctggctctatccattgcttagtggaagcagaagttcattcctctttcattgctgagtagtattccattacagggaaatagcacaggttgtttgccattcccaccccatccctaccctgataatgagtgtttgggtattggctattctgaataaaccggtattggctattctgaataagcctgctttgaacattcttcccacaacagattttgagggcatctgttttcgtgtcccttggggaaaacctaggtgccgaattgcgggtaccaaagagtgggatatgttcaagttcataaaaactgcaaaaacttgtcccaaagtagttgtgccattttacatttccaccaatgacgtgtgagagttgtggttgttcttcatcttctccaagattgggtgtttcctctccttataaatttagccatgctactgggagttatagtggtgtctcgatgtggttttaatttcaattttcctgatagctaatcatattgagcgctcttttatgtgctttgttgaccatgtgtgtaccttttattttaaagtatctgttcaagtcttttacccatctagcacatttgggtttttttttttttttttttaattaccagttaggaagatctcaccacagagtttggaggtcagataggttttgtgactattttctcctcatctgaggctggcttgtttcttcattttctttatggcgtcttttgatgagaagatatggctaatgttcatgaaatcgaatttatcaagtctttcccttttacatgtgttcttcggtgccctgtttaataaatctcatctaccaacaagtcacaagtatcctcgaaatgctttatacctttaacttttaagttttggtctataatgttccttaagttactttcgagtgtagtgtgaggaagaaataaccttgttggtctccctcttcccccatatgaaagtccattagttgaaactatttcctttgccccattgaactgcttttattgaaaacctatggtcgggcatggtgcttacacctataatcccagcacagtgagaggctgaggctggtgagtcacttgagcccaggagttggagatcagtcgggacaacatggcgaaacctcatgtctactaaaacgcgcctgtagtatgagctacctaggaggctgaggcaggaggatcacttcagcctgggaagcacagtgagaccctttctcagaaaacaaaacaaaattaacaaacaaacaaaaaacctatggaccatatagctgtgggtgagttttgggtctcccaaggcagtctgttgatgtatttgtgtctcccaatgccgcatgcacacggccttgtctgtaacagcttagagtgagtctgaaattcaggttgtgcaagtcctctggttttgttctttttcacacagcataataacctttgaaataggtcataactcatgtaaccatcacatagatcaaggtatgctgtcacttcatctctctcatttcagtatgggacacatgtcctcgctcacctatgctgattgccctcctggggccaaggatcctctcctctaccctctgaagagaataaatctccagttgtctgcagggaggatgaacatgcaaaaagtccacaacactcagcacagagtccagattttggtggtggggttgatggggaggaagctcacatttcaggcctttcaaaattgtaggaaaagttttctttatttctaactgtgaaatgtacaaagctttgggtcattcataatttcttcttcttctagaaagatcacaggacacctaatgtttgtgtccccccaaaatgccttggttgaaactctaaccttcctccacccacacctggaaagtgttaaaattaggaggaggggcctttgggaggtaattagatccagagagtggagtcctcctgagtgggattagtgcccctataaaagggacactagagagctctctccccctctttcagccacccgcagatacaatgggaagatggcagtctatgaccaggaagaggttcctcaccataaccctaccatgctggcaccttgatcttagacttccaaactccagaactgtgagaaatgtctgctgtggatgagccacccagtttatggtacattgttatagaagctccaactaaaacatagatggagtcccatggagggtgtctaatttttgatgctggttgttgagttcttcgagtggggtgttgcaaattagaaactgagggagagctgacctttcctgcatatgaaagaagagagtggaaaggaagggatacagaatggggaagaataagctggtaccaaaaaactgatttcagggtctggcacttgaatgtctgattttggagaaagagaagacactggtaggtgtagccagagaagaagactttcagtagaaacagcagatatttaaaagccattcgattacgtctttcgcttgtttgtgtgtagaccctcttttcatatctttgtaagtgtggcacaggtgaactggatgcatttgtccaatgtgtttttggaatgcatgtgtaaataaaaatgactgtgtcatacttcaaatatttatcctggaacctcctagactccccttaggttctgccaacaggacattgaaataacaggcccgtcgtggggattaattttcattgtacattataggaagagggaggaggaggaagaatgggacagtctcaacaacagttgctatagtcttaccgaatatatgcttctcaacagatcagcccttaattcaaataagagcagttggaacgacaaaaggtgttcagttgtacccttggaatccacagaaatcctgggtagggaagctcgagtaccaccaactggaaagacagggatgcctagtagctgattcggggcccattgtcgtaggctttgtccactttgcaaactggagacagggactcgactcaccttctccagccactggaggaccgggaggaccttcagaggaggtgaggtcgacttcatggtaactttagatcctgaaacctcacaggatttttcttctcttccctttgatctctcttccgctaacccaacgggacaggactcgccgcctttctttccggtcagaaaggagtcccttccggacaggaccgaaatgagcagcttgttttccctacctgtccttttgggcctgggcttcttgggagcttaggctgaccggagacctacctcggggcgagtgggaccagcaggagccgggaagggcgcgcgcaccggggtggaggttgggcgccgggggtcgggaaccacagtcacaccctcctcttccccgcgcgcctcccacctgccccctacgatgccgaacgaagtggcccctaaggcttctctacaggccaaaccgaaagaggcctgatgctccaggaggggcgagaggatcctcggtgagcgaacccagccttctacctggctggccctggtcaacaggctcagaagaggccgatttggaggacagaacagaaggaaagacctaaaggtagaaactcatgatgtcgagatgttaaaagcctcaaatcctaaggtccgactgtgccggggagggagggggtcttgagctggatcgacccctgagtcttcatctggagagtcctctgcacaagctcagagagcaggactaggcgcacgaattctagacaaggggcaacttcgtcctcacacgcctcccccatccccgctgggacattaggccacgactgggggaagcggggagggagaatgttaaccccctgtcatctatctagtcagcggaggcgagggatgcggctaaacaccttacaatccaccgaagggcccctcccccaccccgtaatacccattccgcggaggtggagaaactcgcgtgtagatcaatgcccacgcacttggccgatgggaaatcacgaattggtgaccagttcgatcttggccctgaggaaaaaactcaaacgtcagcgggaacccttggagctttgcccagagcatacggaagggtggcgttgcagtatagcctaagatgggaaaatggcaggtattgcaggttgcagggagaccagcagggagatcggagaccagttcagggccccggagccttcgtggaaagagtttcccatccagcccgtcttggtttccgcatatgtctgagtcctttatgatgtcggggatgccaaggtctgagtcttttatgatattcggggtgccccgatctcaccctgggagcctcctcgctcctgcctgctcctggttacccagtgcgcggctctggcccggtgacccgctactgtctctccatgcgctgccgcttcacaaaggcgcatctctaggtcggtggtcaggttctgcccggacgctgcaactggctccgggacttgtgtccttggtgagcctagcggagtgctgggtgcgtcgcctgcgtgctcctcttttggagaaaggagggagggaacggccttgtgagacgactccaggagcgaccagcgacctccacaagtcccaagtcttcccagcgcacagggaaactgtcacttacagggaaactgtcgcttcagtggcaagaaggttgaaaaagcccctcctgtgcctccctggtggtctggtggctagaatttagcgctttcaccgccgcagctcgggttggattaccagtcagggaattgttttgcactgactgccttcccgcaggaatcttcctttacgcccgctgtaagcgggccttctccaagggccagacgcagaacagtctccgcagcgaggtgcaaaccctggcgaaggagggcaactcctggtgggccacctctcatgacacagcgctcttatttatctccgtgtctgtcattcgcacaagcggctttagagagcgactgagcgtctcgctcaggtgtacaccgctgtgcagagatgccagccctcctggaactgcacccaagaagcccaccgtctttgccgcctctgccgtcccggaggcgccgatcgggctgagctgcgaataactaagagagaggccaaggcaagtcgtggcgtttgtgcgtgccacaaattatcagctgacaggggacggtcagtggagcctcctcacctccgttcgcgggtaacgtgcttcttaggccttcagaagaagcgactggaggcgatgcccgcgaggttggaagtggggtgagcggcgggtgaggccctccaggaccgctcgtttgtagactgagcggtaaagggaggcgatgtttgctgacccaacaaagacagcacgtggagcaggcacaaatggaaaactgtggccggtgaacagaaggcaggtgtgaaaatcactaggtcgtcaaagcgatggtaccgcagtcaaatcccgcaatgtctgtctacactctaccaagcaattgcgcacgtttccccttttccattcagtattcccaagaggggttcggaggaaccccgcgtccactgtaagctcaggggggagccggagccagggaggtgaagtgcacagactggacagaggcggcgggcagaaccgcgggggtgagagggcgcggtggctgcggagcgggagccgctgttgaaaggaggcctgggttgtcctgtgggtgactgttggtggaatctttcgcggaaagcgttttggaagaatggcgcgacgagcgagcagaggggaaggtggtgaccctgagcgctcggctaggggagaggaggctgtgctgtttctcctcttcccttacctggcgggggacagaccgtggtcaggaagggggttctccctggttgaggctagtccaccgcactctggctgcgctcacccctgcgatttccccacacgcggggccctagtctgcggtggtgttcgtgctaccccggggctgggttcgcgcacgctcctgacctgccttggctcacggccaacgcggatatcgccgccagagacccttcgccgccctcccagggctcctgagggcgcttccttggtgttctcactgaagctctcgaacagacagatgtgagctctctgtcttttacacgctgaatttggctattggcaaaaaagccctgacccagagcttgggtctccttccgacctgcacacgactccccgactcccgcctccaagcgcggctcttggctcgctggcgggcagcgtccacagagtgtggaaccgccgcagccgcagctcccgcccgctggcgggcagacactagcaggagaaaggacacaaggcctgcgtggtgggaaagcatgggagacctcgctttcccaccggacgagaaggtctccctgcagtctttggacaccagatggatggaggcaccccttctaggaacaaggcggctgctcctgaggcctggcttcgcacagtggctcctgggtcccgcgcgccctctcccttcccgcggtagcaagagctgctttacacatctcagccggcttcctctttctccccagctgtccttgggacagcaaggcccccagcccgtaggaaagacctagcctcctctccagcacttgtagagggagtcggatgcacgtctcttaaccacaggaagacagagaccctgaggcgggagcttcccttgctgcttctcttggcacagcgggtccagggggctggttcagggcccaggactcctcgctcctcctggagggcctgggtcgcgtggcctaggagctggccacatgggcatctccagcactgctcctcagggaacgggaggcattatcctgcaggacccactcttacccatgagagacaccgggaaatgctcctgcggaagctggagctctgcgcgcttgaccacttcggggtgaagcttccgtccgcccatccttccttcgaggggccttggggagaggagaaatgctccaggacgatgccctttgcagtgtctcaaccgagaccagaggaaaggagggtgcgtcttcctggaagaaggtggccgaaggcctgcggtcgccgggaggcttgcggagcaggagcgccctctctccgcccgagctatccggtggcttcctgcatcccacctggcggactcctcttcctctctctccttctactccggctcttctatcctggtgttccctgaatgcctatcttccgtctgtgccacggaacttctcacacccgctacaagttactcatttccttggttgttctgaactttaaataaggtaatgtatgttaccttatgcatttttcactgttaaaaatagacaatactgatgattcagatgatgctactgatgaaactaataacagaagacaattattgagcatttatggcactcttacatacatgggatattgaatattttatgctaaagaatttgaggaaatatttatgctaaaggaatttgagaaaacaacagaagcaggaaggtcactgtcaccctccccctgcgcttcttccctgaagcctatcataagactctcatgtgagaggtgccctctctgtacccagaggaaaggtgcatccttgagtctgaagacacagggacacagagaagagcctgaacacagagacctggctacgttatctccagtttgttactgttagatcatacatttttttgtcttatcatacttctccatgagtatgcactcttcataaaacatactgtttaaaaaaaaaccaacaacaactgagatttagctctttccacaggtcttcgtttcctttgaaggcactcctgtcatgtaaaacttacattaaataaatacatatgctcttctcttgttagtctgtcatatatattatacacttataaaagtatatatatacttatatgtagtttatatatattatatataagtatatatatacttttataaaattgagcttagactctattttacaaatattccatttaatagtgcatgaatttaactgaagacaaagagacagaaacagaaatcaaggaattcctgaactctcaatcacagagagacacctttctaaggctaaacatacactaaattaagaagacattaagatttggagggtttttttctcttttcatgtagtatatattttattagtttgtactaatatattatcatattacaaaggcaatttagtggaagaatcttccttctgatatttgaatcatctgaaagaacacaaaaagaactatgcattcaaaaaaattctcatttggataacaaaaaaaagacaagttaaacaacaaaaaaacttttcctttctcacaggtggacattgaagtgaacctaattcggttttccttttaaaagccccccataaacaaaagtagtttaaaacctatttaaaatgaataaaagattggtttactaaactactcgtctccagcaccattttctcttttctgttgtttggacacaggttcttctttgtctgtttcttctcctgatcttttcataggtccagttgcaccattttcatcatgttcatcatcattagcaaatttcattttcttgccctgaaactgtactttttctttaccagacctaggatgggcagctttattaccctttccttttcctttaaatctgtgtccttttgacttccatatgtttagggattcttgttggtcttctgttatttttttcagtgcttctctttccacctctccttctagtacttcccaagtcacttctttgctctgtaattgtagattaccattatttacatctttggctttacccaacgcttccttgtctttttctttaaatagaattatcccctcttttgctcctctgatgaagtctatccattttatttcaccatgacttgagaaaaggatgtgtaaatcttctctacaggtctgatcatctaaatcacctgaaaacttcagcaagcatccaatcttctcttctagagatttcatttcagcatcttcttctaacttttgatttgcttcttgctcttgtttagctcttaatttagcttccactttattttgttttctttcttcttctttctttttttttattaatattatttttttggcaaagtaatcatctttgaaaagtattagcaggcctgtgtctgtacttctggccaggggtctctacaaacttcttagcagattcaatgctatcaaacacaacaaaaactgatcccttaaatattttatgcaatgttcttctcatctgaatatttagtacttgatctttatcttctaatcattcttttatgtcatcaagagttgcatcagttcggaagcctttaatataaacagatctgtttctttacatcatttttatactcatcagtcacttcaggtaggggtttgcttgaagaccttctgattttagttttatcttcactgattttcatgagttctgccttggatttgctcaatgcttccacaattacattaaagtctgttgttagatggttcaacctgttgaattttatcattatctccaaagatacccagccttcgtccagttttatctgttcccttaaaaacttgtctcctggcaaattgaagtctccaaaataatactcaatttgatgacagattttggcctccagggcagccatcttttcattatcatcattttcagccattgtggctatctttaaagttccagtcccatagagccgtgccacaggctcacaaacagcaacagcaatgactcctggagtggttttcttattactttttacaattaagttgatcgaagtgtgagttgactaggtacaatgcatccatttcaagtttgatgacaggtctattattctaaaaggtcctcttttgcgctttgaagtcagtccccgctttccctgaccccagcaatcaatgatgtagtttctgtcagtcactatacaggtaagttttacctgttctagaaattcaccttgatggcgccgcataggatgcactcttttcatcactcagcataatgtttttgagattatccatgctatctcatgttttgtaatgtgtcccattttattgctgggtagttcgggtagttggagtagatcgcagcgcattctgctgacaggtcagactgcggttccgacctgcgggcctcggtgaatatgcgcaagggcacctgggcgcgggcagagccgttcccatccacaaaataagcatgttatgtctacaaccgaagggggtcacagagccccaaaggccctgctttcatcgcaaagaactgagcccgtcggcatacagtttctacctggctctatgaggtgagaacacattccccgccagcacagaaatcctataaactcctgtggggcagcggttagaagcagaggctgttaaaggtaactctagaggctgcggaaaaacacgaagattttcacagagcgtgagaacccaggagactggagaccacgggccaatctctgctaaaagcagccccacgtagaaaggaaagcgctctggggccatcgcgctagttagcttatgttaaacaatctcacctcggctgaccttataatttctccggcggcaaggacaacaaccaacgcgttactttctatttcatagcctcctaactacaaggaaaaacacttcggatgccgtccaggatataacacgatagactgcatgcagtctatctttccacactgcaaaaaaaaaaaaaacgggggaaaagagcgaacgcagtctcccactaccacaaattatgcagtcgagcttcccacatttggggaagttgcacgaattagcttcgccctgcgaaaaccaccttcgtaaacacgatttttcttctgctaggtaaatgtgagtctgcacgcttccgccccggcacagcctcatacgcctcaccctttacacgcacggtcacttgccccgcgcaccctcgaggcctcctagccctgatacacagctaggactctcaggtccgaccagcggtcctggactccctcccacagcacgggaactccttcgtggcgaagccgccggtgacgaagcagcagcccctgcgctgcctcatctacatagaagtcgccctatccctgatgtcactgacagcgccttccccgtcccagtcagcttttccatcccaccctccgccactcagccgaacaacatgctgccacagcctgcgggagaagtgacgtttgcctctccttctttttcctcccttccgcgccgctggtctcccccaaggaagagggttttgatttttgttttgttttgttttttgttttgaaccggagtctcgccctgtcgcccaggctggagtgcagtagcacgatctccgctcactacaacctcccttcccgggttgagacggtttttctgcctcaggcttccgagtagctgagattacagcccggctaatttttgtatttttagtagagacggggtttcaccactttggccaagctgatctcgaactcctgacctcaggtgatccgcccgccccggcctccgcaagtgctgggattacaggcgtgagccaccacgcccggccagaaacgggttcttagcctgtgttgctgaggacctctttggcgggcagctggagcctgtgcacccttcttcaaataatggcttttaatacactgactagaacgtttgggattacaaaagaaaccagttcttttcacatcgttattcttgtgatgtagcattctacttgaaattggaagccgttcaatatcagagagaaaccatatctatgaaactagagaggttgctcagatgactgcaaaccagccatccttagttgttttaccactagtagtgttataaagatggttgtccaatttcgtgaatcttgtagggtttttgcaaatacagcaatgtacaaaaatatgctgcctcagcagagcacactggacactcaggcatcatgctggagtttgtcatctcttccacagccttctctagaccttagcacttacctcatgttagcacttcatattgtgcaaagacagaaacaaagtcacccaaatttggcaaaaaatatttgggggaaattttattggaggtgcttaactgattaattttaatctgtagaatacaaccccaaactctgacaatactccacagattccaaaactatcaggcgagttttttcctgcccattactttcatataaactgaatcataaagtgtgtagtgggttttgagggagtgtaaccacctgatgggttcaccttgtctgctgcctagacacagccaatttatcaagacaggggaattgcaataaagaaagttatttatgcagagccaactgtgtgggagaccagagatttattattactcagtcttcccaagcattctgggacaggagttttcaaggataatttggtgggtgggggccagtgagttgggagttctgattggtcaggtgggagatgaactcatagggagctaaagcatcctcttgagctgggtcagttcctgggtgggagccacaagaccagatgagctggagtaaggtggtattgcattgtggttttgatttgcattaccctgattgatagttagtgatgttgagcatgttttttcacatgtttgttggccacttgtacatatcttcttttgagaattgtctattcatgttcttagcccactttttgatggaattatttgtgttcttcttgcagatttgtttgagttgcttgtagatttctaaaattcaaatgcaaccaaaaaagaggccacatagccaaagcaagattaagcaaaaacaacaaatctggaggcatcacattatctgacttcaaactatattataaggtcatagtcaccaaaacagcatggtactggtataaatataggcacatagaccaatgaaacagaatagagaacccagaaatgaagccaaatacttacagcaactgattatccgcaaagcaaacaaaaacataaaatggggaaaatatactctattcaacaaatagtactgggaaaattggcaagccatatgtagaagaatgaaactggattctcatctctcaccttatacaaaaatcaactcaagatagtcaaagacttaaatctaagacctgaaattataaaaattataaaattataaaaattctagacgataacattggaaaaacccttctagacattggcttaggcaaagacttcatgaccaagaacccaaaagcaaatgcaacaaaaacgtagataagtagatgggacttaactaaatttaaaagcttctacccagtaaaagaaatcatcagcagagtaaacagaaaccccacagagtttgagaaaatcttcacaaactctgcatcccacaaaggattgtggaatttgtgacataaaaataaaattcttggctgggcatggtggctcaggcctgtagtcccagcaatttgggaggccaaggtgggcagatctcttgagacaagaagttccagaccagcttggccaacatggtgaaaccctgtctctaccagaaatacaaaaattaactgggcatggtggtgcatgcctgtaatcccagctattcaggaggctgaggcaaaagaatcgatcaaacccaggaggcagaggttgcagtgagctaagaatgcgccactgcactccagcctgggcgacagagcaagactctgtctcaaaaaaattaaaaaatatttaaaataaaattcttgtaaccatagcacacagtccaggaggggagatagagagatataatactctaaggctcttactccatctttctttctttgtttttttgaaacagggtcttgctctgtctcctaggctgcagcatagtgacatgaatgtagctcactgcagccttgacctcctgggctccagtgatcctcccatctcagcctcccaagtatctggtggtaacacctggataattttcaaattttttgtagtgatagggtctcaccatgttgtccaggctgctgttgaactcctaggctcaagcaaccctcctgcctcacctcccaaagtgctgggattacaggtctgagccactgtgcccagcctaattttatatttgaagtggcataatataactacaaggtagacagtgttaactagaaaatatataatataatccctaaagcaaccactaaaataacaaaacagcaatgggtaataaacaaataagttgaaatggaataataaaaatactagtttaatacaaaagatggcagaaaaataaaaaacaaaatggacaaattgaaaattaagaggaaggtaaaactcaaacctagccctttcaataattatattagatgtaaagggtctaaaaacaccaattaaaatgcagagattgtcacattggataaaaacaagattaaccatgtgctgcttagaagaaatgcactgtataaatgaaaatacaaatgtgtaaaagtaaaaagatggaaaaaaatatactatgctaaacatagtcaaaaggaaaaagaaactgctatatgaatatcagatgaagtagatttcagagcaaaccatatttccagggataaatagggtgatttcataataataaaggaattaatttgtcaagaagacataataatcaccccctcaccatgacagaacttgaaagtacataatgcaaaaactaatagaactgaaggaaaaatagataattcaccatattgtcagagtttccaatgcccctctcttattaattgatacaacagacagaaaattaacaaggttatggcagacatcaagaacacaattaaccaacttgacctgaataatgtttgcagaacacggcacccaaaaagaacataagatatattttactcaaatgcacatgcaccattgaccaagacagactatattttgggccacaaaacaaggctcaaaagatttaaaagaattcaagtcataaagatgtgttctttgataacaatggaatttagttggaaatcaacagaagaaagacttttgcaaaattccaacaaatatttggaaaatgaggaaaatacttataaattacccatggatcaaagactaaatcaacagcaaaattagaaatttttctgaaaagaatgaaagtgaaaacacaatatatcaaaatgaggaagggggattatagcgttgaaggtctatattaaaaatgaaaaataaaaaatcagcgtatagggctccagtgatggaagccccaaaatctcacaagtcaccacaaaagaacttactcatgtaaccaaataccacctgttcccccagaacctctggaaataaaataaaaaataaaacaaaataaaattgccaaaaaaatttaaaaaatgctttcaaatcagtgacctcagctttactttaagaaactacaaaagaacaaattaatttccaactaggaagaaagtaaattacaaaggtaaaaattaaaatcaatgacatagttttgggggtagggagtatgttgtcattccataatattagcatataaattcacggtagttcttctctgtggcgccttctgttaaccgaaaggttgctggtttgagctcacttaggaacagaacctactcataacctataaagacttttgatcagcttttatgtttcaagcagccacttcatcctgcagccctcacttcctcctcatgatttcctcctttcatcacccagggtgttcatgaaacttctcccagcaaactcgttttcccagatctttacatggtgccactgctcaccttgcactccctggaatgcaaagggtaccttcactcaccgcatcgacgctctagattccaggggaactgccagggtcagaggctgaaggcacaggcactgaatcccttcctcaagcatgtgacatcagaagtcaccttctaagtaaccatttgctctcattccagattgttgcatctcaatatgcaatgttcatcacaggatcagaggacaccacaaccctttgatttagggctgtcttgtccttacctttttcttttcaactaaatttaagtacaaaaattttaccattgtaaatatgtgattcaactgtatggagtttctcaacgtgtaccataatccacttttagaacatgtcctttaccttcccaaatttttccactgccactgtagcaaatcctactccctcctctaacctcatccaacaatttatgttttctgtctacaaatttatctttttcatataaatggcatgaaacaatatgtagtcttttgtgactaacttgtttcacttagcataatgctttaagattcatccatactgtagcaggtgtcagattttttccttcttattgctaaatagaattacattgtacagataatgccacattttatttatccatctaccactggtggacatttcagtaggagctagtttttgctattatgaataatactgccaagaacatttccaaagaagttttctgtgcacctgtattttcatttatcttggatagatttctaggtgtggaatagctgagtagtatggcaagcttctgtttaactttttaaaacactgtcaaactggattccaaagtggttgtatccttttacattcttcccagcaatatatgagggttccattttctccaccttctcagtaacagttgatgttctctgtattttttttaacatagccacattagtgggtgtaaagtggtatcttattgttgttttaatttgcgtttccatgcaaatcaacactacaatgcaataccaccttacttctgcaagagtggccataatcaaaaaatcaaaaaacaatagatgttggcgtggatgcagtgaaaagggaacacttccacactgctggtgggaatgtaaactagtgcaaccactatggaaaacagtgtggagattccctgaagagctaatagtagaactaccttttttttttttttttttttttttttggagacggagtttcgctctgttgttcaagatggagtgcagtggcgcgatctccgctcactgcaagctccgcctcccgggttcacgtcattctcccgcctcagcctcccgagtagctgggactacaggcgcccaccaccaagcccggcaaattttttgtatttttagtagagatggggtttcaccatattagccgggatagtctccatctcctgacctcatgatccgccgtctcggcctcccaaagtgctgggattacaggcgtgagccaccgcacgcagccagaactaccatttgatccagcaatcctactacagggtgtctacccagaggaaaagaagtcattctatgaaaaagatatttgctcacacgtgtttatagcagcacaattcacaattgcaaaaatggggaaccaacccaaatgccataaatcaacaagtggataaagaaactgtggtttaagaaaaaaaaaaatatagatagatagatagatagatagatagatagatagatagatatatgatggaatactactcagccataagaaggaatgaattaatggcattcacagcaacctggaggggattggagactattattctaagtgaagtaactcaggaatgaaaaacaaaacatcgtatgttctgactcataagtgggagctaacctatgaggaggcaaaagcataaggatgacacaatggactttggggactcagggggaaagggtggaaaggggggagggataaaagactaaaatttggatttagaatatactgctcaggagataggtgcatcaaaatctcaccaatcagctgggaacggtggctcactcctgtaatgccagcactttgggaggccaaggccggcagatcacctgaggtcaggagtttgagaccagcctggccaatatggcaaaaccttgtctctactaaaaatataaaaattagccaggcatggtggcacgtgcctgtagtcccagctacttgggaggctgaggcagcagaatcacttgaacccagtaggtagaggttgcagtgagccaaaattgcaccactgtaatcaagtcaggtcttgaactcctgacctcaggtgatctgtccacctcagcctcccaaagtgctgggaatacaggtgtgagccactgcccctggctgctaggttgcccaaactggtcttcaactcctgagctcagatgatccacccacctcggccttccaaagtgctggcattgcaagcatgagtcaccgcacctggtcaattgtgttgctttatgttaagttgaaaaacttctttaggtattgtgaatagaattgttttttattacatatttaattacaaatatttgctcctagtctgtggcttatatatttttctctaaatagtgtcttttgaagcacagaatttttaaattgtaataaaatccaactaatatttttctcttatggcttatgttttttctgtagtgtcttaggactctttgcttaactcaaagtcacaaagattttctcctatgggtttctcttgaaattatatattttaggtctatcatttaggtctgtgatccattttgagttgattgctgtgtatgtgtgatcttaggcaaagtcccctgggggagttttgtccagatattggcaaggaacttggtggtaagtgaagtttaagagttatcatcccctagcccaggaaacagatttcatactcctgcacctgttagtgattggctaagtgccttgggagagatgaatgggatgtgtgggtcccttactcccagatatgtcccattctttgggacctgggtataaagtggctccagttccccaaggatagttcttctcagaagaatctttggaagaaaaacacagcagcaaaagcagggaaggattatacagatgggctaatagggatctcaggtgatctaggttgagctcctacagggtctcctcctagggtggatagaaaggaggatgggcatctcaataactcagtaaacacacatcttgggagtccagagcagattggaggcgttgcacaggtttgtaaacatttttacaaacatgaaaacagtggagttgtgtttatgtgtgtgtttgttttgctgtggctgagataaggtgtctggatctgaaatttagacatactccccacaagggaaggacagggaaactacctagcctcctgcaacaacaagagagattctgagctcgggcagaatccaaaggatgggctggcattatctaagctcaagccagggaccctacacttttatgatttgttggatctcctattttttggttacagctagaccagcagccaactgctaacaccctgagtatagaaatagactaagaaacatattatttggacataccacattatcaccctcactattagtggtggtcccactgtaaatgggaatgtgcatctgaaatacttaattaacttgaaatggattaaaactttgtaaataaaaaaaataaaaatcaatgtaaatttaaaaaaataaaaaagtctccattattttaggagggttatttaccaagattaaggatatgcccagaaaagaacagagatccacaggaaaaaccgtggcccactttttacccaaagagggtctggggacctcaatatttagtgggaaaatggcaggtagtggggaaagaggaagacattttttaaagggtgtgggtagatacgaggcaagttgttgcatctggttgcaattcttttgagtctttgatcagctgtttacatgtggggggtgggtgtaaatactcaatcacttagtatttgtctcgctcagtgaatctgcatttttacataggataatgtaaacataggacagagaaagcaattacatatgtgtttgtccaggtgagcaaggggatgactgagtgttttcctttgtcctgtacctatgaagagaagctatcaatttacattgtcaggttgaaatttaacaggactgttttagggtaaagatcttggggcccacaaggaatgtcgctgtgatcaaattgtgagaaagttatgtagctttatatttgtattctattctattccacttattatttttattatttttattttacctattctatttaggaataaaatgggaggcaggtttgcatgacccagttcccagcttcactttttcttttagcatagtgagtttggagtgttgagatttcttttcctctcacaactttttttttttttaagatggagcctcactctgtcaccagactgggttgcagtggtgtgatctcggctcactgcaacctctgcctcccaggttcaagtgattctcctgcctcaggctcctgagtagttgggaatacaggcttgggccaccaggcccagcaaattcttgtatttttagtagagacaggtttcaccatgttggccaggctagtctcaaactccttacctcaggtgatccaaccccttcggcctccctaaattctgggattacaggcatgagccaccacgcccagcctcctttcaaaacttcagtgtaagatgtgaaacattaacattcctagaagaaatcatagagaaaaaggtctttgacattggtcttggaaatgatttttttgcatatggcaccaaaagtacaggaaataaaagcagaactaggcaagtgggattgcattaaactaagcttctaaacagcaaaggaaacaataaaaaaaaaaaaaagaaaagaaaaggcaacctgtggaatgggagaaaatatttgcacccatcaatagggtaaggagttaatatccaaaatatatacagaaatcacaaaattcaatagccaaaacaataaataacctgattaaaatatgggcaaaggatctgaatagacatttgtccaaggaacacatacaaaatagccaacaggtgtatgaaaaggtgctcaacatcagtaatcctcagggaaacgcagatcaaaaccacaatgagatagcacctcacagccattagggtggttattatcagaaaaacaagtaagtgttagcaaggatgtggagaaacgggaactcttgtatattgttggtgggaatgtaaattggtacagccattatagaaaacactgtggagactcctcaaaacattacaaacagaactaccaaacaacccagcaatccaacttctgggtatataatcgaaggaaatgaagtcagtatctcaaagagctatttgcacccccgtgtttatcacagcattcttcacagtagtcaagacatgaaaacagcctaagtgtctaccgatagtgaatgaagggtcacctcagaacttacacccactaggagggcatgtcgaaagcaggctcacttggccacttttacaacttacttctgaccagaaaggcaccaccttggctgcccagtggataactgcctgggagcagggagactccctgtccttgctcacttccccatttacctaataaaaatatccactttttgctccaaaggagaggttttgtgcttctcccccaagctacctttggaaataaattcactttttttgtagcgggcctcacacttaattggactctacatgtggtgagcaactgacctgcttttggttacagaatgagttttagagatctaatgtacagcgtgagaactattgttaatgctgtattgtatacttgaagtttgctgaaacagtagatcaaaagtgttctcactacactaaaaaaggaactatgtgagaaggtggatatgctaattagcctgactgtagccattagttcattatgtatatgtatatcaaaccatcatgttgtagactttaatagtatagcattttaataaaaatttttaaaagattcctttaaacaaacattaacaataccatcgaaaaatatgaactacatagcaaaagaggtgaacacctgtacactgaagactatgaaatattgcagagagcaatacaagatctttggaggccaggtgtggtggctcaggcctgtaatcccagcactttaggaggccaaggtgagtggatcacttgaagtcaggagttcgagaccagactggcaaatgtggtgaaacccattagtctccactaaaaatgcaaagaattagcccggagtgctggtggatgcctgtgctcccagcaactcaggagtctgaggcaagggagtcattttaacctgggagacggaggttacaatgaacagagatcataccactgcactccagtgtggatgacagagtaagactccatttcaaaaacaaatttaaaaaattaaaataaaaaagatctttggaatataagttatttatcgtatttttcaagattccttttgctatttgcagatacttgcaatttcttccaaataaaaagttctgtttttttaatttctgaaaaaacaggccactggaatttgaataacattacactgaatctgtagattgttttgagtttcatttccatcttaaccatgttaaatcttccaacaatggacacaggatgtctttccatttttttagttcttctttaatctctttaagcaatgttaggtagttttcagtgtacaagtatttcaccttcttaaatttattcctagatgtgttattcttatgggtgctattataaatgaagtatattaattttccttcaaaatttttttcattgctaaagcaactggtttttgtccatttatcttgtgtgctacaagtttgccgaattagtttattaactcccgtaatgtgtgtgtgtgtctgtgtgtgtgtgtgtgtgtgtgtgtgtgtgtgtgtgtgtattatttggtattttctctatataggatcatgtcatctacaaattgagataatttgttttctttccaaaccatttttgctcatcttctttttttttttttttgagatgcagtctcactctgttgtccaggctggagggcagtggcctgatctcagctcactgcaacctccaactcccagtttcaagcaattcttctgcctcagcctccagagttgctgagactacaggtgcccaccaccacacccaattaatttttatatttttagtagagacagtgtttcaccatattggccaggctggtctcgaactcctgacctcgtgatccgcctgcctcggcctcccaaagtgctgtgattacagctgtgagccactgtacccagcctcatcttcatttttgaaaaagattttcagtgggtatagaattctaggttgacttttttttcagtacttaaaagtattgcaaacttcttgtttgtaatatttctgatgagaaatcagatgccatccttacatttagtcctcagtatataacatatttgttccccttttagccctcttaggattttctcttcattactggttttgatcaatttgagtatggtgttccttagtgtagttttcttcatgtttcttgtccttaggatacattatgtttctgggatatttgcagtttatggtgttcatgaagcttagaaagcttccatccagtgtgttttaaatatttttctatccctgttacccactccattcccctcagggattccatttacccctacagtagggtgtttaagcctcccattgatgggctttttatgttttcaattcatttttccctgcgtgtttcatttgtgttagtttcttctactactccttctagttcattaatcttttcttctgcaatgtttaatcaagtgtattttttttaaacttcagactgtaaatcgcagttttcacttatggaatttgatattaaaaaatatctcccaattcttcacttaattaaaattataataactgctgtaatgtccttgtctgctatttctaacatgtgtgtcattttcaactgaattatttcattcttcgttgtgtctcatgttttcctgtcacttgcctgcttgagattctgggatttgatgccacacatttgatgtcaatgcccaaatgtgcccagtggcacaacacggcctcagtgtccatgcacacccaaacttgtgcagcaggagaggcaggagagcagaggcgagtgtgccacacatggggtagggagtaccccacttgtgcttggggctttcctctgcctcattgaaaaaataagtgttccttttcttttccataagacctgccctatttcaagccctgtccctccaatgataggacagtcctctctccagtctcatgcctgccaatgggcggacaatggttcaaaacaattcaggggagaaagcattgtcctgttaacaaattctgctgaaaaaatggacatccataggcaaaaatagaaaaaaatccacaaccgatgttggcaaggttgcatagaaaaaggaatgcttttacactgttggtgggagtgtaagtcagtctaaccattgggaaagacactgtggctactcctcaaagacctacaggcagaaataccatttgaccagtaattccactactgggcatatacccaaaggaatataagtcattctgttataaagatacatgctggcatatgtccactgcagcactatgtgtacaggatggaacatgaaggcagactaggagcatgaccactgaagcacagcatcacagggagacggttaggcctccagataactgcgggcgagcctgactgatgtcaggccctccacaagaggtggaggagtagaatctttgctaaactccccaggggaaagggagactcccttacccagtccactaagtagtgggtgtttttccttgacactgaggctaccgctagaccacggtccacatggcaatgggcgtcttcccagatgctggcattaccactagaccaaggagccctctggtggccctgtccgggcataacagaaggctggccctcttgtcttctggtcacttctcactgtgtcccctcagctcctatctctgtatggcctagtttttcctaggttatgattatagagcgaggattattataatattggaataaagagtaattgctacaaactaatgattaatgatattcatatataatcatgtctatgatctagatctagtataactcttgttgttttatatattttattatactggaacagctcatgccctcagtctcttgcctcggcacctggatggcttgccgcccacgaaatataataactgacacaggcaggagtgattaattgatgataaaatgttcagaggaagatcgttagaatacaagatatttatactttttcaaaccactttccaaatgaattataaataaggagtctttacaagtgaaagatctcctaggcccctccttaaccaactgaccagtcctggtatcatgatactggtgatggacaaactggaccttctctgcctgcagatgggctgaggtaggaaactcaccgcattgactctgcagtgttcccagcaaaatgtttaggctgaatttaatcataaggacattttcagacaaattcagaatgtagaccatgatctagacagctgacctgtcctctacaaacaaatccatgtcaccaccatcagtgacaacaataaaaagatgagatgctttgggttcaaaatgaccaaagaagtgtagctacattatcttttcaatctttttcaacccaaaatgtctcttctcttttttgttgtgtgattcatggtgacgtggactgtgtgaaggagataggtcagttgtcctgctcagtgttctacattctgcagttgtctggtgattacctcctacgaaactcaggctaagtgctttcagcaagaacgtggcattgttcttattctgcactggcaaagtcccgggtgacatgctgtctcctgccagcggctcctgactcctgttctctacgggataggaattgagaggagcagggctaaggcctctcaatgctgtttgttcatctgggcatcagtctccttaggtactgatcatagttgatcacaattggagggggaagggctgtggcttctcaaatcaaaggaggctggtgggttaaaatcatcaacagcatttcatggtcttaagttcacttctcatcaaaggatccctgtggtgttgtgtttgatcttgaacttgctttgctgttttagtcttttccatcaagtgaaaaaactactttgatgacatcctttcatccttttcattcttccagcagtatttggtatctttaggggagagagagacaaaaatcaaatgagaatctttgtctggtcctgtctggctgagtctggagggactgctaagtgatgataacccaggggcaaactgagctcctgctgggaggaccagctgcagggtaagcctcaggctggctgaagtggcaggtgccatccacaagtgagaagaaaataccccagaacttccagtcagcctggggtgcagaatgtagggacctcatctatgccctactagcaactggtaacatcagtacctttcttcctgattagctctgtttggagcaaagtgattgcttttcacatctcccagtgaggatgtgcttagcatcaaccatgcatgcccagaaacagagggctgcagaaggagaggaccctttgcagagaaacccacccccttacaactccatgtcccagtcttttaagggagcagtgggaaggccatgggaagaaccctggatgtgagaagcagcagaggcctcagaccacatccacatccagttctgcctttcacaacagaggagcagtgatgccacagggctaagattgaactaaggccacatgagttgctattgaccacctgggaactacagcccagcctcagaccctttcaatagtgtttggaagaagggagagaaaaggctccaatctggactctcaacagtcatgagaggctgttgggtcaccttggctaggacaggaataaagttttacaatgaaatatgatttcactgctgcttgtttggttggttacaaataaaaaatgaaaaaaagagaaatatagaaggctgggcaaggtggctcatgtctgtaatcccagcattttgggaggctgagacaggtggatcacaaggtcaggagatcaagactatcctggctaacacagtgaaaccccgtctctacaaaaaatgcaaaaattagccaggcatggtggcaggcacttgtagtcccagctactcaggaggctgaggcaggataatggcatgaacctgggaggcggagcttgcagtgagccaagatggcgccactgcactccagcctgggtgacagagcaagactccgtctcaaaaaaaaacaaaaacaaaaacaaaaaacaaaatatatatatatatatataaaatcataagtattctttccaaggggctcaggaaagaaagaaaaacaagagagtctacttgcagttagcaaagagagagcagggattgtaaccatggcccaacttattttctctaattccctgaagttgattccacacctggttacatcttaagacatttagaaatattctcaatatctagacaaacaaaactttgaagtgagagggacgcccaagatggtagcaatgggaacagagcagagttcagagagcaaagagcagatgggaatggaaggtcctgggagggtggcagctcatgggacacagaggtaaaaccagacagacatgatggcagctgctggagagaatgaatagggaagagaaaagcaatgggagaatgagctgtcatcatagacacaggagtgagtgcagctaagagccatagatgtgattacctttttacactaggcttgcaggccagggaatctgcatgccagtctccacttgctgaacagcagttttcttttgatcatattcggttttaggacacttgaggcatgaatgtggccaatgacttgatgcccatgtgtgttgtcagctgagctttcaagagcatccccttccagctggggagggttcttcattcaagggaaggctctaaacccagctctgaaaatgaaaccacacccaacagtgttcactgtcatccatgatcctactgtgactttctcttcctcccaagaggatcatcagagaaggaaagtggccttggacaagaaagtccaaggggtaaagggaagccaagaaagacattttggtattttctgcattgttgatttttcatgcatcacccaataatgacaagattgccaggaggcaaaggtgatctcaattgacaaacatattcaagaaacttaggattaataaacacaaatagcttctaggtagataaggcaaaggcaaggaagtcacactggatacaggctgtgttttgggagggagaagattctaaaaatcaagcaaaatcaacattaaatgcacatatgagagaaaagaattgggaagactaaacatgggatattgatgaaatgatcatacagatatatatatagcatatatacacatttaattaaaaatacatgccaaatatgcataatgtacatgacaaatgacataaatgcatgtatttatatataaaaatctattggaagaaagtattacatagggatgtggaggatgttgaattagcattataatcactaacattataatctggtccattgaaattggaaaaaaattcagaaaaataagatgaatgacaaagggaagacatggtgagaaacaaatgccctattagacagcagggagaagtcaccagtaaaggagaatgaaacaaaaggcattcactctgtcctcttgcctggagcctggttagtgctctggactcctgggaaacccagcaggtgagagtgttggagccaggtgggtgagtcctgactgggggtgtgggaatccatggagaagcaaaagagacatcagtggaagaaatcagtttaaatacttaaagttatcagggcacatgtcagggactacacatcccccgacattcactgagcatcttccatgtgtcctctccacgacccagatggtgctctttatctcacatgtccctccctcctcctgaggacgcaggtctccttattcctcagctggggacatcacttgacagatgagcaacaggcagccccaggggctccaggaggagatattgagtgggacggagagtaaggatgaacacgacccagggttttaaggaaatctgagcagaagtggaaccctgggagaaggaaactgaggacatggccatggacgtgagtggagatgatgaactaaatggagtttcataaaacagacagatttgtacactttccatgagaaggttgccctttcattcttttatttcaaaacaagggggaaaaaaaacagagcaagaagctgggtatgtcaggagactgacttgtgggcccaggatttgcacttttactgaatgtgcctaataggttgttactgaaagtgcttgataggggaaaattgacttaaaaagggatgctgacaaagaggaagaaaactggcaaaagagactttcgaagaaaacacaggaagaggggtccctagagagtagagaccctaacagttactctccctaagatgaaacagtgcatgtgaagtcacttcctgtagggagaccccctgaaactattgctatggaataaaagatgaaatgctcctgattattgtaaacacaacattgcatgcaggattgtgtaaagacaatgccaggttgggcgccagaatgagccaacagcgcatgatgtgcttccccctgcagagaccctatgaacggacgtgcagtcagggaggtttcacatcaccaagattcctatcccagaaaagcagatgttcatagctctgggaatggaatgcaacccttgtggagagcctataaatggacacatggggggtgcctgttcatatggataagatagggctataaacactctcatcttgccacggctcttctaggcctctttagggttaaggcatactcccttctgaggatttctggtctaactggttatctagcttcacgtcctgtttctatggattgtttgtaaccagcttttgctgcaactgttactgctgcttaatatcttgctaatcataggttatggaaagactgtgcttctgttttaaggctctgttagaaattactgatgcacacactatactgtaaattcttatctctgtatactgtacttctgcatacagatgttatgttaaaaaattacttcatccacatgtgaccatctcactcataatcagatgatcctaaatccctcactaacctactcccgccctcactaaagttaataataaatgctggtatatcccgtgcattggcagcatcatgggaccagaaggtggtgacacccctggatccagctttcactaccttgtgtgtgtctattatttctcaacctgccgatctgcctgggaacaaagaaagaaccctgttgcattgtgggctgctggccagatcccacaatacttcctaagtgctaatttaccagaaagataacagaattagataacatctattcatagatttattgagcaatttttattgaattagccctttggaaattctcataattaatgttatcaacaataattgaatgttaatattatttttcaggtctcacagatgacggaactgagatgtaaataccaacaccacaaatgacttcgccaaggtcaataatgagtaagggttaaacccaggacctgagagcagatttgatcctaaaccccaggctcttgctcacctcactgggttggaacattgtggatttctgcttgactcagagggagcacgaagagaccccattgcctcctcccctcacagcaccatgactaccaacacctggattagagcttcctagtgccctttccttccctaccttggaagggccattggttcccaggatcaccgttggctgtgaagctgcaggtggtggaggaaacgccccacctggctaagccatagccacagtcaaacccttgatccagttgcagtcacagacaactgggcaccagggttcttggctccagctgtgcctgtgaagcctccacctctgacaggtggtggctcaagtctccactccaaggcccgtgaggacaggccacctgggtgggagctgaaaggagaaggggcttcagtaggaacgctctcacttttccctttcttaatcatgcccagaacacccatctctgacatctccgcctctgaggtaagccacccagtggcccaggccacaaagacagacatcatgtaaatggggtgatgtcaccttcctgtctgtgcctggggatgctgagatggaaggtacccaggctggatgtccctgaagtgaaaaccccccacttcagcccagagggctttggattggctaacaaggccatgccaaatattctgttattattaatctctatcctgcagcctagaaagaatgttctggagaatcttcagagcataggaaatgctatttttctcaacacacaggagtataagaataggggaggacttagagcctccaggctttgggaaggaaccatagaaaagggttttgggacactgtagactagcagtctccaaactttttgccccagggattggttttgtggaagacaatttttccttggaccaggggtgggggatgtgaaaagagggaaggatcatttcggaatgaaactgttccacctcagatcatcaggcattaattagattctcgtaaggagcgcgcaacctagatcccgttcatgcacagttcacaatagggtttgtgcttctatgagaatctaatgccaccgctgatctgacaggaggcagagctcaggctggaatatgcttgcttgctggccactcatatcctgctgcacagcctggtgcctaacagaccagggacaggtagctgaccacagccccgggggcttggggccccctgcaatagaccaaatactccataaggtgaactttttagagttctgaaacattttgaatttccgttgcctataattgttttaccacctgcccacacatatacatcttgttgccatatagtgggtgtccgcagtcataagcaatgttgtagagggaccagtcccttcaccgacacttaggggccacaggtattaccgatcagcatgtgtggttctgtagggaggcaacaccaagcacaatcctcatcttacccactcctccagtggggtccgggcagcaccccctcataaaaattattgctatttccacaggaagaggaaatcacactctcagaaagtggactaaggaaagacttccagtggcctcacgccagtccagatcggtctcagaagagggacggggcccgcagggcctgatccacattgctgcagggctcctctctctctctcctcccctctgcacatcctcattctcaccaaggtttctctaagttttccttaaaatgccttccgtgtatctgttcttcatcttcctgagagcacagtgtatcagacttgaaggggtggcctgcccctccacacctgtgggcgtttctcatcaggtgggacaagagactgagaaaagaaaaagacacagagacaaagtatagaaaagtgggcccagggaaccagcgctcagcatacagaggacccacgccagcactgttctctgagttccctcagtatttattgatcattatctctaccatctcggagagggggatgtggcaagacaatagggtaatagtggggagagggtcagaaggaaaatatgtaaacaaaggtctctgtgtcataaacaaagttaagaaaatgtgttgtgccttgatgtgcacgtatacaaacatctcggtgcattaatgagcagtattgccactagcatgtctcacctccagccctaaggcggttttctcctatctctgtaaatagatcatacaatcgggttttacaccgagacattccattgcccagggacgagcaggagacagatgccttcctcttatctcaactgcaaagaggccttcctcttttactaatcctccttagcacagaccctttatgggtgtcgggctgggggaagatcaggtctttcccttcccatgaggccatatctcaggctatcacatggggagaaaccttggacaatacctggttttcctaggcagaggtccctgcggccttccgcagtgtattgtgtccctggatacttgagattagggagtggtgatagttttaacaagcatgctgccttcaagcacttttttaacaaagcacatcctgcatagccctaaatccattaaacctggagtcaacacagcacatgtctctgtgagcacagggttggggctagtgttacagattaacagcatctcaaggcagaagaatttttcttagtacagaacaaaatggagactcttacatctaattctttctacgtagacacagtaacagtctgagctctctttcttttccccacagactcatcattgatgcctggcttcatacacccccacaactgctttctctaattctgccatcttcacactaggaattgtctcagcaattttattgcccagaagtcctgttctttccacattcttactctgtttctgaaaactctctcagtactgcccactgggtgactctccccgctcaccctgcctttgtgctccttctaacttctgtcccatgatcctatccagcatcacctcccaccactccctcatacagtgtcttccctggagtcaggttggcccctctctggtgcagccctgcatggggtgccttccagcttctgggtctttgtccccgagcccttcacgccacctcatgtggcctccttagttgctcagggcacagtttactgttcattaaacatcacttaggacactcaatgcaacttcatggtagtttatgttgggcagatggggaaacaactcaaaacaacaaatctggttggggaagcctggtcaaacccaggcttcccattcttgtcctctgcaagtgccatttagaatcaatgtttgggaatgtttttaactctaaatacttaattttgttaagtccttttatccctgtttctcagaatactaagtcttcttaagcttatacttttaatattctttgcattttcagaaggaaacaaaaaacaactcaaacttctgaaatactgtacgtattattagttgagcaggtggggaaaagtcctcaataagtgatcaagttatgatttagtttgattctactgtaactttccctgaagcgagaggataggtggagcacatcgattctggcaccaaggctaggatcacagctgtgcatggtacagactcttcataggttatcatcagaacccacacacaggatgtcttctggtgtaattgagacagtgcattcatgcatctcagcctgtctgcatggatgaacgtggcctctcctggcccatgtttcatgatgccctggcagagctggcccatatcacagacatctcacttctgagacatgtatctgagcatttcccttcctcctcatgggagcctggacctggtgggggtgttcctgaggcagagcccagtaactttataagggctccaagactgccatgttgagagcagaaacccaagtgatacaaggtaggaacagactgcatctttcattccctgagacattttccagcaagcaccttctggagctgtaggtccccctggagggactgaaggagccactggttctgctcaaagacaaagtgcactaagctatttatcactgggttatgtgcgtgaggggctacaggagttctttgtaccagaccagcaaattttctgtttcagtttgaaataatttccaacaaatttgctacaaagggaaaaaccttgagcactcatcctagctcagtctctgagagatccaaccacagagaaatgacagcaactgcaccatggagtggtgcccgtgttctcactgtgactactcggggcatcctgggcaagtgaagggaccttgctgagcctcagcatcctcagctctaacacggagatgccactgcccacttgggagtgccccttgggcactgcataggttatagcaaggatagagcttgcttggccaagggcaaggtgtacaacaggtggaagcgtaatgtgtattttacttcattttatgaattgctgtgatcctgcaaaagcctttgcttgtttgaaactgaaggagaaatgaaacacaggaaagaggatggttccagcaggaaggtgcttactgaccaaaatagaatggaagaccaaagtttcagtcactactttcattacaacatattcagatgggggacatcacagagttacttgctcttcctacaagagtcaacgggtaaaactcgtaacaattcacgtgaaattctcagaataatggtacaaaaaaacagaatgagtgagaacaaaataaaattttttttcccttacacaccctatgaaacagccacctcaagggtcacttgctcacaggaggggtttgctggagatcatggggatgagaaccactgtgctttcttcatcagttaggccagcacctgatcagggaaactagttgttgatggttcacatgagaatatagcactgagatgacacatgattgaaactacaaacccacacatgaaagaaaccaccggggctctacagaggatgcaagccatggccatacatggaggaagggacactaactgcctcagtggagggaagccacctcagaggaggtagtagagaatctggcttgaaacacaggaatcatgaaacagccctccaaaataatggggggaaaatgccagcataggtggatggccagagaagagagaagggcgctgctcaggatatgtgatgagaagggtgctgctcaacataatgtctgaaaagagagatgccctatcttaaggaatgaagtctgttatataaaattctccaggtgagctgttgtggccaagagtttgcaatgatccctcatcattcccctctctggcctgttttgatacctacagcctgctcttgtgagaaggggttgggtgacagaggaatcacctggcacaagagaaaggggttccacccatcgaatgagcataaaactggatccaagaaccagattcaaaacactctgaatttacagggcctggctgcagagatgatccatctcacctgcacaagttacaggaaacagaacatatagaggccacctaggagaatagtagagctttgtgaccttcaggctggagtactcacaggctacatcgagagcaaagcaggtgagctgatcctccaatgagtacaacgtgctgttgtaaggttgctggcagtcagacaggtcatgggggagtgaaggagtcaagtaaacttcatccagggagtcctgtgggacgtcctgttcctccacctctggcagatccgggctcagcctggtgggtgaagaacacagaagataaacattagagggaacagaaactacagtgcccaattgattctacagagagtctgacaggagaagccagaggaagcaaaaaacagtcccctcaggcagagaatgatccttctctgtctccagcaggagacagagcagcaggtgctcagtgctctgggtaggcagtgagctggaaaggaaggagatggaatgatccctctaccaaagagctatgacacggcacatgcagcagacccttgtgtcttcatagactgatagagttactgtgacctcaacacctcttgttctcaaaattttggcatgatatgaattatgtgtattcacattcctgctctcagatatttgccaatataatggcaaagacccagacattggatgagcatctcaagttcactttaagccaaaaaggcagaaaaggaaactgcagaaaatgtgattgatcagttcaacaaagtcaattgaataaagattagtacaattttgaaggaatcaataagagaaacaaatacaaatataggtgtaaaatgaaaagaggcaactttattaatattgtaccaataatattaatattgactaataatcctgcttaataattattccacactgataatcttaacattactaatatggcgatttcatagttggctgaatgaatggacaggtatgttctgttatccctgtatctggcatctccagatatcaaaaataaattaaatgtctgcaattgctcaaagttacctggggcattgtgggtcttggtcttcttcttcttcttgatttttttcaatgtctgcaacaaagtcagacagggacagacacattaagtctattcccctattcatgcaacaatccactgtccaatcctaaaacaggaacatctgtctcctgagcatgagaagaggacactgtgagagatatattccaggaggcctgagggtcagacatgatacagattccttggtttttgtctctgaacctaagggtgaaatgtcccctgttctggtagatcattatcccagtatcatctgtcctgagtttgtgcaacagttatgcaatattttccctatcaattcaaagcaaacacccaaaataatttctggaaaaaaagactgcagtattcagtcctgtctcatcaaatacccagcttgttcacaaaggcgaggattttagacactgaaattacaatgagggagaaaattaacaaaccctagagtcaaaaataactctttggttctttaaaaaaaacattggttattcatggcatcaaaaacgtgacagggctcagtcttgcttccaaaaccaaaacaaaaggtaacagacagatcagctaaaacaagcagacattgaagatacaaagaatgaggttaggttaattaaaaccagggtaacacctttgcatgagctgtacacaaagatgacgttgaccttgagcaggtattgaagctcagagacatgcctgcaaaatgaaatccctgaggaactttgtagctacccagagatatgtggctcaaattaaaatgtctgatagattactcccggcatgtgctgcatagttatgtgaacgtgtcacaactaacttgggtctaatgtcttcagactgagcacaggttgccactggcatggtctgagaataggaatagagccatgcccactgacccatcctatgtctgggcttccaactggaactagggtttcattcaaacctacaggcgcctataggtcctgcctgtggcaacgacatctctcagctcagtaagggctgctcagtgcaggaatatgacccctatccagaagaccaggtggagccttatcaccttcatagtaaggaacctactgtccacgtaaagagccaagccaacatgctattcctccaatgagtaaaaggcacttctgtaggactggcatgagtcacgcagttcaactggaaggagttgaataacatctatccagtgagtcctgcaagacttcaggcccttccccttccagcagctcactgctgagcctggaaaagtgggaaaaattaaagagtaagccaaagaaaatcagacaccacagagccccagctagatttcatgagtagcataaggtagtagttataaaaagaaaaggatacatccattaatgaggtaacaaattattggctatatcttgggacagaacagggccaaatggaaaaggatgaaagagaaagacagacagagagacagagagagagacagaaagagagagagagagaaagagcttagtgaattgtccaggtgacacactgatgagggagtaataggacactccgagttagtgccctcaggacacacagtgtacagtgatcatgaaaagaatgggctcaataattttccataaaatgtgcttaagtttccatgcagttgccatgagaatacagcttttgaagtatggtccacctacggtaggttagtaaatgataaggggaggaagaaatggaaacctaaatatctattgcaatgaaaaccaacagcaatgttagtaggaataattcaggcttcgttgaaaagatgtaatcgatattgtcagcctgctctgttttctctgaaccaggagtctcaaagtgtcaacagagaagtagctgttcacaattgctcaaagttacccggggcctggtgggccttggtcttcttcctcttcttggtcctttttaattcctgcaatacattcagacagggacagacaaaataagccaattcacctacacccataacagcccactgtctaatccccacacagggatctcaggctcctcagcatgagaacaggacaatgtgagagatatacttcaggaggcctgaaagctggtcatgatattctttgatttgcatctcagaaccaagggtgaaatatccccattctggtagatcgttatcccaaaatcatttatcccaagttgtggaaacagttatgccttattgttcccatcgattcaaagaaaatgtcccagatgatttctaggaggaaaactgcagtattcagccctgtatcatcaaatacccagctcattcatgaatgcaagaattttagacactgaaattagaatgaaggaggaaacctacaaacccttgagtccaaatcatagttctgtgaattttttacatctgcctgggtccaatgtgttgagagtgggctcaggttgccacaggcatggctggagactaggaatagaaccatgttcactggcccatcctatgtctgggcttccaagtgtagctagagtttcattacaacctacatgcacctataggtcctccctgtggcaatgacatctcgggtcagtaagggccacttggagcaggaatatgacccctatccagaagaccaggtggagccctatcaccttcatagtaaggtactcactgtccccatcaagagccaagccaacatgctgttcctccaatgagtaaaagtacttctgtagggctggcatgagtcaggcagttcaagataactggtaggagtcgaataatatctatccagtgagtcctgcaagacttcaggctcttccacttccaacagctccctgctgagcttgaagaagtaggaaaaactaagggtaagtgagggaaaatgagaaaccacagagccccagctagatttcatggggcataaagaagtggttaaaaaagaaaagggatagatccattaatgaggtaacaaattattgcctttatattggaataggccatggctgggtagtaaatgatgaaagagaaatacagacagaaagaaagagagacagacaaagagaacttagtgaattgtccaggtgacacactgatgagggagttaaaggacactctgagttggtgccctgaggacacacagcaaacagtgagcatgaatagagtgggctcaataattttccataaaatgtgctcaagtttctgtgcagtcgccatgagaatacagcttttgaggtatggccaaccttcactaggttagaaaatgataagggtaggaagaaatggaaacctaaacatttactgcaatgaaaagcaacagcaatattagtaggagtaattcaggcttggctgacaagaatgaaatcattattttcagcatgttctgttttccctggacttggcatctccaggtgtcaacaccaaattaactgcccacaatttctcagactcacctgggacatgttgcctctcgatcgtcctttttcacttgatcacactgaggtcctgcaaataaattcagatggggcctcttacattaagcagttcttccttgcacacagaaacattcctctgtccaatcctaacacagggacttcagtcttctcagtgtgagaacaggagactttgagagaaatattccagtaggcctgaggtcaagtcttgagaaaactggcttgggttctttcatgagccttgggcaaaattcccctgttttggaatgttatcttccctatgtgctctgtcctaggtctgtgtacacaaatgagcaatattttccccaataaattgtaggcaaatagttctaacacctcgtaggagagatacttcaatattaagctttctctcatcaaatacccagaatttgatagtttatgagattgtggacactgagatttgttggatgggtgcaatgtaccagctcttgagtcagaatgagtcttggtgctacacagaagcatcagctattatggcttttgtgagtgaaaagtcaactgtttatctagaaaacataccagcaagatgatggacagatgagctaaaacaagccaacttagaagacacagaaaatggagataaattcagtgaaacctgggtcacatcttccactgagaggtagacaagggtgacactggccttgggcaggtaaagaaccacacagacatgctttgggaacaaaactcataaggaattttgtagctggcaagagacatttaattcagatgagctgatctgacagacaactcctgggcatgtgctgcacagtttggtgtgagtttgccacacctgccttgagttcaatgtcgtgacagtcagtccaggttggcatgggcatggcctgagactaggaagagagcaaagctcactgacccaccccatgcctgtgcttcagactcgactccagagtgattgaaatctacattgatatataggttcagcccgcagtgatggcaactctcagtccaaccaggggcacaaggcccaaagattacggggtctacctgggatgctaactggagctttatcaccttcacaatggagtactcactacctatgtcaagagccaagccaacttgctgttcctctaatgagtgaaaggtgctcctgtaagactggtacaaggcagatatgtcaggaggaattaatagagtcgaataaccttcatcctaggactcctgaggggcttcctcctcttcagtctcctgcagattcctgatgagccaggcaggacagggatgacagaagatttaaccaacagagattagacaacaaggcctttcagctgatccaatgggaaacagaatcgagtggtcacaaaaagcaaaggcatttttccttcaagagaaaaaaagctatccttctaaatgcagggtagagggtgactgctctggggacagagcaaaaatgtgcaggtcatgctcagtgcatttgccacagatgagccactgcagggcacccagactctccgtgtaaactaccatcatgacttgcaacacagagaactaacacagggcttcaaccactttgcataaattgggttgaattttacatgcagcattcaagtgaacagagctcttgaggcagtgcagacacacagatcttgtgtattaagggcccccttttcccaatattttgatatatatgtttatttttgaatttcttttcttgtgcaaatactagcaaagatactaacaacaaatgggcagaaagcatatatacatctctccctggatttaaacacatgggagagaacaggcaataccaagaaatccctgtttggttagttcacctggctcatctgattgcaggttcctatcttgagaggactacaaaattaaaaccaacacaagtgccatgaataacccacaacagtgttaataaggacaatttgtggtggggttaatggaagaaattgttctattcatcatttcctcattttccctggatctgcagtctccaagcatcactattgaactaatagctcacaattacacagcgttacctgggagacgctggccctttttcttcctcttcctcgtgattactttgattttctgtaaataaattcagagaagcaggtcacattcagcaaatcacacttcacatatgaccaaataagtgtccagtcatagcacaaggacataaatattctcagtgcgagaatatggattctgacaggaatgttatagattaagtcttgtgtgaagtagatgagcctgctttccagacccacaggccaaaatctccctctatgtgtagaccgtaatgccacattccctgcctgagtctatgcaagttaaacaaaattttttcccaaaaaatctccaaaacttggtcaagctactttctgagagtgttgctgcaatactgacttatctcaccagataatatggtcattgaatgtttaaaggcatctatgcatgagactagactgttggataaattctaacaactctgtcttaaaaaataatctgcaatttgggaggccaaggtgggtggatcacttgaggccaggagttcgagaccagcctggccaacatggtgaaaccttgtcagtactaaaaatataaaaaatagccaggcatggtggtgtgcaccagtggtcccagctactcaggaggctgaggcaggaaaatcgcttgaacccaggaggcagagattgcagtaagccgagactgtgccactgcactccagcctgggtgacagagtgagactctgtctcaaaaaatatatatatatgtgatgctacgaagaaacattggacattgatggagtggagaactcagggcccaaccttgctctgtggaaacatatcagcaaggtaaagaataaatgtttccatcctggtttcaaggtgactgtgcagctaagcaagctgacttaaaggagatcaagactgaagctgagagcagtgaaactcggggaacaatatctccaaatacaaaggcaaggctgccagtttccttaaaaaggcataaaaactccatggactttgttcagggacagatgacataatgacaggtgatgagagatattggatctaagctaggaggcttgatagatacctcctgcacacctcctggacaaaggtaactatgagtttgtcccaattgcctggggtccatgacactgggaacagggagacagaggcatgatatgggctgaggaggagaggaaaactccctaaacctcctgatatctgtgtttagtaccccatcctaatttctaattcaaaccaatttgtttgtatagagctctttttcagagttgatcttcctcagcctagacagaggtatgagggacagggaatatagagtctacctgggagaatgtgtagagcatcctcccattcatcatgagaggattcactgtctacaaccagcccagagtcaaatttgtctgcctcaaatgtgattttggtgttcctgtgtggctggttggagtcctaagtgccgtggctatttgaacaagtgacggcacattcctccagtgagtcctcagggacttccttttcttcagccttctgcacctccctgatgagtcaggtgggatagagatggcaaaatattaaacagagagggattggacaccagggagtcctagccagttttgacagaggcataagagaattgtccccaaaagcaaaggggtggctccctctaagagggaacaggcactcctcctctctctgcaagagattgtggatgccatgggagccaaagaggaagagagcagctggtgttcattgcactgggaagataggagctgaagaagatggaggctcaactgtctctatgtgtgcagatgtgacactcagcatgcatggagaaccataacagctgctacatcgtgtgccaaagttgggttgaatttaaatactgtggccaaaggaatacaggctcttgagccactgtaggctccagaaatggtgtgccttctaggtcttttttttttttaatattgtgaaatgtacaatttttttctaggtacttctcttgatgtttatattttctagaaacttcctaaataattcctctgtttgttacctctttactatttttttgagacacattctcgctctgttgcccaggctggtgtgcagtggcacaatcttggctcactgcaaactccacctcccggattcaagcgattctcctgcctcagcctcccaagtagctgggattacaagtacccaccaccacacctggttaatttttgtatttttagtagagacgaaattttgccatgttggccaggctggtctcgaactgctgacctcaggtgatccacccacattggcctcccaaagtgctgggattacaggtgtgagccaccatgcctggcccacctctttgctatttatctttcttaacaagaacctgaagacaatcatgtagaaagcagctttgcatctcctcctggttttcattacaggagagaacagttctctgtgaatgcaggaaatccctagggctggtgggtttatcgagggtcatgcttacaaggaccatgaagacaatggactagggctatttccttgttgggtgagcgcatgaaatgagcacactctgcagctttctttaccctccatctggaatctgtgactaccttcaactcacttgtattctttctaagaccttttccatggtttatccacccactacctgcctgattattcagtgttacctgggggcaggtgattctcatcctttatgaatctcttcatctttatcattttcattatcaccttcatcattctctgcaaacaaatatagaagtgtccatttagatattcctcacttcacacactgcaagtacagcaagccctatgtgcacagagacattaacatctatgtatgggtcagcattgtgctgaaagctctcatgttttatctttaacaaaattccctggtatggtttcctgatccatcaggcaatgaatttctgatctggagggccaccatcaagctgtggccaaatattgaaaagaccttttgctccccgtatcactggaggcttgtccagcatctttctggactttggcagctgtcttccccatcctgccacagatctgattcccaggcacaggatcggtgtcctgtcacaactctcacatttagaatatatttctttctcttacgggaggacaaacagccttgtcccacctttctccatgcattgggagacttcacaagccctccaagttggcttctgctgtgttattcagggacattctctccatggggagtgctccagtctgaagcacttcctaccaccaaatgcccccacatcaagtgccttctccaacaccacacggtgaggggcttcatcttattttgaaatgtaatcataagtgttcccatatttgaatgctgtatctaccattgaagagacattttgacccctgtagagatttagacaaagaaatccagaaaggataaatcaatcactcacccaaggttactaaggacattgctgaagatacagcctgggaaacttcattcttaatccaggactctttttactctaacaagttgcctcctgtcacagcctccttcctatcctttaaaactgaatggatatggcctcttgctccaaagaacgtgactatcaaggaggaggagacatttgcaatactgtgacctctaaccccatggacttcttgtctctgttcctacccaggaaatcctggtcatgtcatggccacatatgtttaatggaaagaaacaccacctatgtaactgtcattgtggaggtatggaggtgtagagtctctcacaagcctggggttttgtgtcatcagggcctgtggtctccttatctgggctgagcttgtggacaaggtgctcagccagcctgctctcagaggtcctgcccctgggagttgtcagaatcatcaggagtgaggagggccttgagatgctgattcagtaagaggaaggcatctctcccttcccgtaacttgtcctgtaactgggccggctctcgggcctgggagtgaacagagactttatattgcctaaggtgggatagtagagaaaatttagtagtggaaagagatgagtgatcagttctaatatcgaaacaaaggagccctccacgcagaaagtcagcacatattaaaggaaatgcctgttgcaaagagaaagaaaaatgtatttttttaaaaaaacaggtcttccccactgcgatagagagagagagctccaggaagatttttcaacattccattcatctttttcttctgtaaccaaatcagttccaaaaggattttccttcaatttctcattttgcctgtggacattttcatgttcaaatacacatcgtgcattattcagtgactggacacaaagccgtgcacagaaatgtggccaggtacaactggaaacatgaaagaataaaagaatgacagtgtcaagaaggcaatagtggttgaagaaatgagaagcccaagtcagttaggagttgattctgactaagagtaaatgcagtggtgatcgcacagcatcttgagtatactgaatgctgctgggtagttcactttcctttggttaattttgtgttatgcaaatttcacctcaacaattacttgttagaaaaagagaaaacgaggctctgagaaataactgcaacccataaattactattattgttctctgttttataaatatttgtgtgacatgtgtctgccatggcaattcctgcccttcccctggctcggcttagctcttacttctcccccgctgagctgctgcacagagattcacactcctgcccacctgcctgcccccaatggggccccctcacctgagctttccagcttgcctgagcttctctgccagcttctcctccttgaactgcagctcatccctcagcctagattttatgaggtctttgcactcttcacactctgagaaaagacagacacacctgcctcagtggaaggctggacatgctgttgcagtcactgcctacagggcaggagccaggtccatcccaaggacaaaactgtccccagtaccaggctctaggcagggattgcacatctttactcttcagtctcctcacttcctggcatctgatactccccaacttagagataggaaaaaagctcaggggcccaccaagcaacttgacaagatgattcacctggaatgaggtagggtcagaattcacagcccctgaggtctgactctgaatcatgggacactttcccaagccttgcagcctctcctgcactggggcataaagtagtgattttctgtacagctgggaaggcttctaggactatgggactgtgaaaggaaaatatcttgggcctccaaaatcactaaggaaaactcaagctgggaactgcttaaggcaaacctgcctcccattctattcaatcactcctctgctcactgagatagatgtatatctgatttgactactttggaaaggctaatcagatactcaaaataatgtaaccatttgtgtgtcacccatctgtgacctggaagctccctcccatggaagctccctctccactttgagttttcctgcctttccttcaagatttcctgtctttccagactgaaccaatttacttcttacatatattggttgatgtctcatgtctccctaaatgtataaaactaagccgtgccccaaccaccttgggtacatgtcgtcaggacctcctgaggctgtgtccttgtgcgtcctcaaccttggcaaaataaaccttctaaatcaactgagacctgtctcagatttgttgggttcacattttggtaaccaccacggggggattctgagtggagatgcccctgacctttgacaaatctcctgtcagtgcttggtaccagcatgagctaactttatggctcaagccaataggataatttgctgagatctgacagcaccccctccagagaatccctgatctccccaaatttggttgagatcttaagtttattttactgtacaactcttctttttttggagttttacttgctttcaacaggaaggcaaattttcctgcttccatgacaatggaatgcaggtaactcctttatgaagtttgagcttgcttcttccaacagggaagatgagttgttttctcttcttctaggatggtagagagcagtctacagactgagaccaatcactagttaagaaactagtttgggattgtatcttgcaaattccttttaaacgactaaaataagcatttaacaaccagctggtgttaatttctgcttacacttagagtactcagaaatcatataatttggatcttcctgcctttgcttcaagttgtcccgcctttccagactgaacaaatgcacttcttacatatattaattgatgtctcatgaccaccttgggcacatgtcgtcaggacttcctgaggctgtgtcccacgtgcgtcctcaaccttggcaaaataaactttctaaattaactgagacctgtcacagattttgtgtgttcacaggactgatttcttttttaactgggaattttaagcaccaatatgtgcaagattttaaaaatcatatctggatataattgcataaaatatgaggcataagaccataaggtcatgaaggaaatatgcccaaatactaatcaagttcctgttaagttagaaaccgtagaatgaagaactaatagtgtttactctgtgccaacaactgttccaggaggtttacaagcaataggttgtataattcattgtagcaatttaccaaggtaggtattattataatacccatgaacagatgaggaaactaaggcacagagaagatgagcaacttggatggagcccaggaaactagcccagggtccctgctttacacactgctacctccacacagtcttgggggctctcttttttcctctttagaaataagagcctcagccaggtgtggtggctcatgcctgtaatcccagcactttgagaggccgaggcgggcggatcacctgaggtcagaagtccgagaccagcctgaccaacatggagaaaccccatttctattaaaaatacaaaaattagctgggtgtggtggtgcatgcctgtaatctcagctacttgggaggctgaggcaggagaatcacttgaacccaggaggcagaggttgtggtgagtcgagatcgggccattgcactccagcctgggcaacaagaaagagtgaaactctgtctcaaaaaaaaaaagagagagaaataacaacctgtgccccaggaagcaagacttccctgtcaccagggtattccctgctcttgatgctgtcacttatggataccacaatttctattaggtgcagactcctctttaagctccttggagttggtactgtgtgctatcaccacgtttccaccagggtcctcagcatggaactttgcctatcaggcctcaacagcctgaactgaatggaaattcattagtcccagatatgtagagccacagattagatgctacttgtctgcaggatcttatatggtacagagagaattcttgtaaacatgatttagcctcttgctgagaaaaacaggtggttctgttcctatgtcagaaatcaataactggtattttaactctagtcccaccccacaccaaattgcaaacatggaaaagttgctgaatactttgtgcctctgttttccatcttttaaaaaatgaggttaaaatatcctcttctgttttcctagaagcatggaaaggataaaattaattttgattaagagagcatttcatctctcagggagaagatgggcgatcattcatcatttttggtatagtgagcctatagaatttactgtacttcttcagctggttggccagggagtaggcaatagtttgagttataagaaatttctctttgaggtctcagaactgctgtttgctctatgccagctgcgagcgcaattcttggttgatttctaggatgttcatctctgccctctcactcaacaaaaggctggcagatacagccatgctgacatttatgccagaagaggttgagccagggactaaggagaagaaacccaaacacataatgggttgaagactagtgaaatcaaataggtttaatcaggactgagggatgacagtaactggaattgttaccgctgagaaaaacttgatcactccccacagcactttagagtccttaaccacaaaaacagagtttgagatgccagatatctgagccaaagtcactgcctgtagctcaggctctgataagagtgaggcagctagtggccagcgtgccaggtaatggcctgcagttgcaataacaaaattagaaggtgggagtgtcatggaatcttaggaaccctgcattacaattgcccagggtttgctgaaatacaacacctcctggtcttacctgagggtcaccattgagggggaccattcgttcagcagtcattctcagtatttgtgtacttttgtgacaatgccacagatccatctctttcccaatacaactaagcatatcctcattgttcgcttcttgtgtgtacaaggcagaaacagtttcccaacaggttatattttcctttttttcttttttttattattattatactttaagttttagggtacatgtgcacaatgtgtaggttagttatgtatgtatacatgtgccacgctggtgtgctgcacccgttaactcatcatttagcattaggtatatctcataatgctatccctctcccctccccccaccccacaacagtccccagagtgtgatgttccccttcctgtgtccatgtgttctcattgttcaattcccacctatgagtgagaatatgcagtgtttggttttttgtccttgcaatactttactgagaatgatgatttccaatttcatccatgtccctacaaaggacatgaactcatcattttttatggctgcatagtattccatggtgtatatgtgccacattttcttaatccagtctatcattgttggacatttgggttggttccaagtcttttctatggtgaatagtgccgcaataaacatatgtgtgcatgtgtctttatagaagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttttccacatcctctccagcacctgttgtttcctttttaatgattgcaattctaaatggtgtgagatgatatctcattgcagttttgatttgcatttctctgatggccagtgatggtgagcattttttcatgtgtcttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcaaaaattttctcccattttgtaggttttctgttcactctgatggtagtttcttttgctgtgcagaagctctttagtttaattagatcccgtttgtcaattttggcttttgttgccgttgcttttggtgttttagacatgaaatccttgcccatgcctatgtcctgaatggtaattcctaggtttccttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtggcgtgatgcctccagctttgttcttttggcttaggattgacttggcgatgtgggctcttttttggttccatatgaactttaaagtagttttttccaattctgtgaagaaagtcattggtagcttgatggggatggcattgaatccataaattaccttgggcagtaaggccattttcatgatactgattcttcctacccatgagcatggaatgttcttccatttctttgtatcctcctttatttcattgagcagtggtttgtagttgtccttgaagaggtccttcacatcccttgtaagttggattcctaggtattttattatcttttagtaattgtgaatgggagttcactaatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatgtgcaaacagggacaatttgacttcctcttttcctaatcgaataccctttatttccttctcctgcctaattgccctggccagaacttccaacactgtgttgaataggagtggtgagagagggcatccctatcttgtgccagttttcaaagggaaagcttccagtttttgcccattcagtatgatattggctgtgggtttgtcatagatagctcttattattttgagatacgtcccatcaatacctaatttattgagagtttttagcatgaagggttgttgaattttgtcaaaggccttttctgcatctattgagataatcatgtggtttttgtctttggttctgtttatatactggattacatttattgatttgagtatgttgaactagccttgcatcccagggatgaagcccacttgattatggtggataagctttttgatgtgctgctggattcgttttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagctcctccttgtacctctggtagaatttggctgtgaatccatctggtcctggactctttttggttggtaagctattgattattgccacagtttcagagactgttattggtctattcagagattcaacttcttcctggtttagtcttgggaggttgtatgtgtcgaggaatttatccatttcttctcgattttctagtttatttgcgtagaggtgtttgtagtattctctgatggtagtttgtatttctgtgggatgggtggtgatatcccctttatcattttttattgcatctatttgatttttctctcttttcttctttattagtcttgctagcggtctatcaattttgttgatcctttcaaaaaaccagctcttggattcattaattttttgaagggttttttgtgtctcaatttccttcagttctgctctgattttagttattcaacaggttatattttcttaatggtagtcatgaagtcaccacactttctctttcagttaaaacagagctgaaggcttttccacaagtgaaagatatcaaactgttagaccgccatgatattctcagcgtcgtctgcagctttttctttatccactaaaaagtgaatgaataattcattttttaaaaatgttttctttcccatctcagtattcttcttgctgcatctcattgttaggttgatttcttttctcttactggatgagaattttgacttttcattgcacttaagacaagtttgacaccactatcttcaaagcttttcttctatgtgtgggttgatttgttttctaatgtcagtgagcactaccttttatacttgtcacttatcgatgtcattctagtcccacaagagctcttttcaaggtatcaagtaatatacatatatcacgtgtgaccatctatcttgggaagttttgtaaacctgatactattttgttgctttcattcagttttcccatataataaaaagaacagggccgtgagcagttcttatggaacactgacatatatatattttctgagtttgtctaacaccattgaagtgtggttgcattccactaacagaacatggcaagatcaagggggcaagacacggtcaggggtggtttgtgatcctcagtgtttctgtgcagtagaaggtgagttttagatgagagggatgagtaggggagagtgatcccaagccacctcctcactttctcagcttttatccccacctaggttttgtgagcctgggactggggagatagtcccacagcccaggtctcctaggtttggctgctggacttgtgtgatttgagggtgcaatgagcatgaccctgggctactcagcattcatgtggaagtgaaggatggaggactgggtcaatctcatttgaaagcatgcctctcagcagcccccaccatcctccaactacactgtgtaaggacattgctttgaaatgtatcaatgtaaataaatttattttctggtgtctgtgagacctgacattatatggcaagaaaaaaattgtaaaatttctttattttaaaaatggtgaaggtcgggtgcaatggcttacgcctgtaatcccagcactttgggaggctgaggtggtggatcacctgaggtcagtagttcgagaccagcctgaccaacatggagaaaccctgtctctactaaaaaaaaatacaaaataagccgggcatggtggtacatgactgtaatcccagctactcgggaggatgaggcaggagaattgcttgaacccgggaggcggaggttgcagtgagctgagatcacaccactgcacttcagcctaggcaacaagagtgaaactccatctcaaaaaaaaaaaaatggtgaaactggaggtcacaaagttacatgactgacttgaggtcacacagggatgagttgtgagcactgccaataaaagcaatcacaataattattcagtagttattcatagaatccatataattcagtaaatatttatataattattcagtaattattcattgaccaatttgtaccaggcattttgctcaaaactgtgcacatatatagacattgtattttcaccataatccttaaagtaatgttgttatttataaaaaacagataagagacctgaagaagagggataacaaattatttatttgaccagatttccatttttttttttttgtttctgtgattctgaaagaatgaacagaatgagtcaagggaagaatatttattatgcatcattttccaaacagaggtgtgccctcctagagtattgggaccaaaattcagaagtgtctgaagtgtgagacttgggtcttcccttgactgtgtttaatttactcttctattgaatacctatgagtctcactaagatttttgcctttttataaccacaatatatgttttatgaaggggattttactattagatctatttagaaagaataaatataagttattgttcaggttttatgcactggacttagtatttttcagatttccgttttgagattaaattctcatgtaaaaagaaaaataactgttattacttataaagaacaaattagttattggtttgagtttttgaaaatgaaacacaaacttctgattttatctttgtttatccccatcaggcgccacccattgtctctcagaatgacctggccttgctcctgcacttagccgtgcagtgctgaaccatctccatgcactgtccaattcactcagtgatttgggctcctcccaaggctccctgaaatgggtacaggtctcaggatgtcggacacattttagttgcaaaagcaacccatactgtagagtggacagctgtgttcttacttccccaaagttggcagagatgtcctaggacatgaaggaatgctttccctttttagaagatctttccttcatgtctcaatgcctctggacaactgtcctgaatgtgaaagaaattgctaaatttctgatcttttgttagatagctagaatagatttataagacttccttactttcccatgtctgctgaaatttgaattcttagccatatgattccttttcttgtaagctgagcagcttaggaaagattggccatgttgctgtgcaaaaagaggtaaacttaatttctactcaaagcatgcttgaatttgaaactagggcttccactcttccaaagctggactgtcactgcctcgggcatgtgtcccaaagggctcctgtctctgctgtactcaggataaagtttaagtggagctcagcaagccagatctcctttacttctaggttcccctaacagtttctcctctgctttagagactgcattgaaaatattcttgttctgctgttgtgttttggctttggaatgatgtgatgcagctcaatgggtcctacccccaagttgatcagagtaagaaacagctgggaaagttggtgcaaatacaagttcattctcctcctggcacaaattttgattctatggtctcagatgggcctggaatgtgtttgttaacattattcggatgtgcagtcagtttggggacccactgataccattgaccttacagtttacaggatgattatttctgttttgctgatgaaaaaaccaaggcacagagagtctgtaacttgcccaagttccctttgctgtaagccctggagccagatctcaagtggagcagcctcttccccatccccttcccacattttccaattcagtcatgtcagttctttccaagtatgtgtttctcttccctataccttatttctacaaacaacagtaagaacaacaacacctttttgaatttaatttgtttcattccatcacagcatgctgtcagcatcatattctggtcacttacttttaatgcaagatgcttgagataggctctcgttctgtcacccaggctggagtgcagtgctgattatagccaactgcaacctcagactcctaggatcaagtgatcatcttgcgtcagctttccaaggagctggaactgtaggcacacatcaccattcctggctaatttttttttttttattttttatagagaggaaatcttgctatgttgctcagagtggtctagaactcctggcctcaagtgatcctttcacctaggcctccaaaagtgctgggactacaagagtaagccactgagcctggccctgagatgatttttttttttttttcatgaaaatacagggcatggaggtgtggaaagacaccttgctttattattgttgttattattatttgtaaagtataattcataaatcacaaaattcaccatttttaagcataccattcagtgtcttttactatattccaaaggttttgcaaccatcaccaccatctaattttagaatattttcataatgccaaaaagcatgcctgtacttactgccagtcactctcaaattctccctgttgtgcagtccctgacaaccactaatctactttatctccctatggatatacttgttatggacatttcctatatatggaataatacaacgtggccttttgcacatgcatcttttacttagcacaatattctcaaggttcatttttgttatagcttacatcagtacttcaatcctttctatggccaaataatattccattatacagttataccacattttgtttatctgtccatcaactgatgatcagttgggatgtttccactttttaactattatgaataatgctgctgtaaattttttgtacatgtttttgagtgaacatctgtttgtaatttgtttggttatataactatgagtgcaattgctgcatcataagtcacttgtttaagtattcgaggaactgacagactcttttccaacctcagtggctataccattttacatttccactagtaatacatgagaattccattttctccataacttttcaaacacatgttgtcttttttttttttaagtaacactagtgggtgtgaagtggtatctcactttggtttaaatttacattttcctaatgatgaaaaaattgaacatatttgcaggagcttgtgggcccttcatatgtaccctttagagaaatgtcgattgaatccttttttctcattgttaaatttggttgtcttttattgctgttttatgaattatttatatactctagatactagacccttgtcagatatatgactagcaaatagttccccattatgtgaatcatcttttcacttaaatgacagagtcctttgaagcatgaaagtttttttattttaataaaatccatttatttatctattttcaggttgcttgtccctatttaacaaatgtctaatccagagtcacaaagatttatacctatgttttcttcaagacatcacttttggaatgagaactttcccgggttttagtggaggatggacattgtttatttatgcctcccgttcattacaatatttttcctgatcggtattcatatgcccactgcccctccatggagcatcccatggcctgtaacagagctctgaggactggtatccttccactaattttgatgctggcgagagctctggtcatatatttcagcttgaatttaacccaacccagttgcatctatagctcagggccattagagttgaagtcaagagccactctgagaatgcttggcagcccgtgctactctaagactgcagtggactttctcagttcattccagacagaagagaccacaggggttggacccagtcaagactttcacctctggtgttagaaagtagacctgcttcagggtttggggaaggttatttaatacgaactagatcctctctaattatttatactgcatgtgtgacttctttctagaaacaacggaagaatatgttagaacattttgtctattctttgtcaattgttgtttgactacaaattttaaagtagataaaggaaagctcagtgtaactatattcttaacacttaattagggttcatgtccactgcaatgtgatcatatttaattctataaactatctagttacttagatattatctggttcctgatgagaaaataaactcagacagattagaaaatttctctaggtcacaaatctagtaagaagaggaataagaattagaagccagttccttttggccttcaaagctaaccttgtaccattagatcaaactgaatgacagtacttttacaggaattggtctcagaatttgtggttctacattgattttcccaaggaaacagtgtgtcattttaatattattttaaacttttaaatttcaaaccttttttaaaattatacattttttgtttgttctgttccattgattttggtttcttctcaatggatccctattatttatatgctgaatatttgttacctatcttctgtcacttttcactttttttgagtgtttgtcatctctccctttgctttatattaacagttcttcactgaggtgtaatttgcatagagtaaaattcaaaaaacataagggcacacttaataaattttaatgtaattatgcattgtataataacacccagatcaagatagagaacattttcccccatgtcaaaaagttctgatgtgcttttgtcagtcaatactcatcccccaaatgaagaatacaatctgaattttgtcactgtctttgtccctttgtgttgctggagaggaataccagaggctgcataatttataaagaaaagaggtgcatttcacccatagttctgcaggctgcacaaaaagcatgacaccaacatcttctcttaatgagggcgtaagactgcttccactcatggcagaaggtgaaagggaaccagtgtgtgcagagattatatggtgagagaggaagaaaaagagagagaggaaaggtgcaaggctcttttttaataaccagctcttgcaagaactaagagaatgagagttcactcactaccttctcccaggaaggggagtaatctattcatgatggatccactcccatgacccaaacacctcccattaagccccacctccaacactggggatcaaattttaacatgagatttggaggggaccaatatctaaactataatagccaccatagatgaatttttttttattcttgtgcttgataaaaatggaatcatttaatatgttctcttgttttgacttctcttactcaggtggttatatatgctactaatttgtttgattgtgcctttctctcattttatattgttttggccaagtaatatcctatttattgtaggattatcacacaatttgatatcatttttcttttttcttttcttttctttttttttttttttttttgagacagagtctcgccctgtcgcccaggctggagaacaatggcgcgatctcggctcactgcaacctccgcctcccagattcaagggattctcctgcctcagcctcccaagtagctgggattacaggcacgtgcctccacgcccagctaatttttatatttttactagagacggggtttcaccatgttggccaggctggtctcgaattcctaacctcatgatccacccgcctcggcctcccaaagtgctgggattacaggggtgagccaccgtgcccggcttgatatcatttttctaatggtagacaggtttacttgttgactattatgcttaagtaactatgaatattctcgtacaattctttctgtgaagacacatacacatttctcctgagtatgtatagctagggatggaattgtttggtgaaaggttaaaaactgacacaaagttttgggaagtagttgtattattttacatttctatgaaaaatataagccatttcctgttgctgtacattctaacccacttaatattttcagtctttttaattttggccaatctaccagatgtgtagtgatatcctattttggttttcacatgcctattggtcatttagatatatttttatgtaaagggtcttttcaaatttttctgctcattgatatactgggttgtttgtcattttctttgtgatctatagttctttatatattttgaatgagtccatttcaaatgaatgagtccatatatgtgtatatacacatacatatacatatacatatacatatgttgcaaataattagtcctggtttacagatagcttttaacttgttaaacaataacctgtaataagcagaagctttttaaaaataaagtacaatttaatttatttctcactgtgatgagtgctacagtatctggtataagaaatattttcctatgtcaagttcatgaaaatattttctatttttcttttacaagacttctaattttaactttcacatcttaagttaaatttaatgtattgtggaaagtggttgttaatattaaatttttaaaacaacaaatattattttactcaagaacttttttattgaaaagtctttcatttcctcaattaagggcattagcgtacttgtttttaaaaaatttaaataactgtacatatgtgggcatattgtttgaaactgcattcttttactttgatatatttatgtatacttacaccagtagtataatttttaagtcattgtagctttaaaatgagttttaaaatatagcagagtaagtcctccaatttattgccgctttaagactggcttgcctgttctagattctttgatttttaaatacattttgaaattagcttttaaatttctctaaaaactactattaaagttattaatcagaattatgttgatgtaatatcctaacaaaatggagtcttccaatccatgaacataatatatatatatatatattttagccttctttgatttctctcaccaataccctttagaggctttgtatctgcttcaatgtatgtattcttaagaatgtaatgattttggatactaatttctattgtgttttattgaatttcattttctagctgctaatagctagtaaggaaaaaataagattatgaagtccactttataaaggtataatttaggtacaacagtctgcaccactttaaaatgtgtaattcaatgcatgtttacaaatgtatacaccaatggaaatactgccacaatcaatatttaggaatttccctatgccccaaagtttcttgtacccctttgaagttcatcagtctttcaactctcagccccaaggagccactgtcactttaggtaagtttgcgtttttaaccattttctataaatgaaattatacctgtgttcttttgtgtctgccttctttcatgcatcatcttaattttaaaatttatccaaatgagtatctgcatcaataaataattccttgtaattgctgagtagtattcttttgtgtggctacaccatgtttgtttatacattcacttgttattggacatttgtgtcatcccatgtttgagctattattaataaagtataatgagcatccacatacagaatatagtgcagacatagtgtgtaaattcctaggaatggaatgactgtccaactgatttgtatatgtttaaccttataagaaactgttagccagattttgaaaggacctgaccgatatgtagtattttaaatgttttgaattttagccattctcatggatacataatggtatctcatcattgtattgattgatctttctgatgactaaagagttgagtatcttttcatgtgctaattgaccattcatgtatcttcttttctgaagtatttattcaagtcttttgagaaactgttttatagtgctgtttatcttatcaaactgcattttttatatatatatatatataccccaaaaaatcctttgttggtggtaaatatgatatctcctatattgtggcttctttttatgttctattaatgttccatattttggacataaagataaataatcttcaaaaaggtgattttacatgtacacatataaattcatgtctaagaataatttattagacatatgtaaggatctatttctggattctctcttctcttccattgatgtatgttctatttttttttaacaatacacatgatcttgatttccatagctgtatagtaattctggaaatatgtagtgaattcattcaccattgtgtttttataatattgctcttttattattcttgatcattgacatttccatacaaatggtagtcagcttgtaaatttctaccaaaatgcctgttggaatttttattagaattacattgatctggagatcagtttgggaaaaactgacttttaaactataacaagtctttcgattcctgacaaggtttatctccccactaatttagttcttttataatttctcaaagcaatgtttggtagtttttagagtaccagccttacataaattttgttgactttatttctaagcacatcatgtatttagaagttactttaaatgaaattgtatttttatttcattttccgaatgcccattgctgatatacagaaatacaacatactatatttatattgaacttatgtttggcaataccttgacaaaatagcttagtttttgtagatttttgtagatttctaggattgtttacatacacaatcattatctgcgaataaagacagcttcaattctttcatttcagtcttttcaatgcctttattttattaatttttttttactttattgatttggttaagatctctagtataatgctggattgaaagagtaacagaagatattctaccttttttctctgatttaatagaaaagcatttgaccatatgccattcaatataatgtcacctgtagctttttcgaatttgcccttagtggggttggaagtgttgccttctgttcttattatgctgagagttttaaggggtttgtattttttaatcatgaaaaagttctcaattttaccaaatactttttctgtgtatgtcaaggtaatcatatgatttttctcttttgtcctgataatatagagaattatattgggtattgagatataacttacatgaaagaaactatgcataattaaagtgtatcattttaaatggttgaatagaatatacatctgcaatcatgatagtggatataggtcgggcacagtggcttacacctgtaatcctggcactttgggaggccaaggcaggcagattgcttcaggtctggattttgagaccagcctgggaaacatggtgaaaccgcatttctaaaaaaaaaaaaaaaaaaaaaatacaaaaactagccagccctgtagtctcagctacttgggaggctgagttgggaggatggcttgagcccaggagacagaaattgcagtgagccaagattgtgccactgcactccagtctggatgacagaaccagaccctgtctcaaaacaaacaaacaaacaacacaaaacaaaaaaaaccatagaggatagatctaccacttccaaagttttcttgtgtccctagtaattccttcttcacctttctctccccacctcaggcaaccactggttgtctttctgtcatagtagatcaatttaaattttctaaagttttttataaatagaatcatatagaatgtacatttttctggtttgattttttcattcagaataattattttgagatgtagacatgttgtcaggtgtatcaatagatcgctctgctatactgctgagtaatatcccacgtgacagatacatcacaatttattttattcattcacctgttcgtggatttggatggcttctggtgttaagactaaagcttctatcaacaaatttgtatggacatatcctttcctttgatttggatgtaatagcagtatcatattgttggtacaggtttactattttaagaagctgccaaactgctttataatgtgcttgtaaaatttcacattctcatcagcaatgcatgaagttttaattcccatacatctttgccagtatatggaatggtgaattttttaactttagtcattttacttggtattcagtggtttaaatttgcatttacctagttactaacgatgttgaataccttgtcatgttgttatgtgcctttcatattttttttttgccaaagtatctttacataccttttattcatttgaaaatttgatttttttgtctcctttttaataatctttgagagttcccttagtgttgtagacaggagttctttatcagatatgtaatgtccaaatatattttccttgtgtcttgccttttcattctcttaccaacgctgttttttttcttttttttctttttttggagacagagtctcactctgttgcccaggctggagtgcaggggcatgatcttggctcactgaaacctctgcctcccgggttcaagcgattctcctgtctcagcctcccaagtagctgggattacaggcgcctgccaccatgcctggctaatttttgtatttttagtagagacagttgtttcaccatgtttgccaggctggcctcaaatgcctgacctcatgtgatccacccgccttggcctcccaaagtgctgggattacaggtgtgggccaccatgtccagccacaaatgtcttttgaagagcatttttctaaaagtgttgttgaagttaaatttattaatttgttcttttaccagttcttagggggaattcttctagcttttgcccattcagtatgatgttggctgtgggtttgtcatagatggctcttattatgttgaggtatatttctttggtgtctagtttgctgagagttttaacatgaaggaatgttgaattttatcaaaagccttttctttatctattgagataatcacgttgttttttattttagttccatttatgtgataaatcaaattacatgttgaaccaagcttgcatcccaggaatgaaggctacatgatcatggtggatttgcttttggatgtgctgctggattggatttgctagtattgtgttgaggatttttgtgttcatgttcatcaggcatattggcctgaagttttttttgtgtgtgttgtgtgtcttggtcaatttggtatcagaatgatgctggcctcataaaatgagttaggttggggtccttcctccttgactttttgaataatttcagtaggattgttatcagctcttctctatatgtctggtagaattcagctatgaatctatctggtcctggcctttttctggtggtaggttttttattactaattcaatttcagagctctttatggtctattcctgggttttattttattttttctgatttaatcttgggattatatgtttccatgaatttactcatttattctagtttttcttactgctttcattgagttttgtatgtattttcacatttcaattttattcagttcagctctgattttggttttcttttcttctactagctttggggttggtttgcttttttttttttcctaattccccttggtgtaatgtcgctttgttaattttctttcttttttctctattctttacagcacagagttgttgatccatagtttgttagtttgagatctttctaacttctccaaaaatgcctgctctcaccactgctattcaacatggtattggaagtcccagccagagcaatcaggcaaaagaaagaaataagaggcattgaaatacaaacagaggaagccaaactatctctcttttctgatgatataattctatatctaaaaaatcccatagtctctgtccaaaggctcctagaactgataaacaactccagtaaagtttcaggatataaaatcaatgtacaaaattgagtagtatttttatacaccaataacatccaagctgagggccaaaacaagaatgcagtcccattcacaatagccatgaaaagaataatatttctaagaatatagctaaccagggaggtgaaagatctctacaacaagaattacaaaacatttctgaaagaaatcagagacaagacaaatagaaaaacattccatgctcctaagcaaattaatgcaggaacagaaaaccaaataccacatattctcacttataagtggacatgggactgcagatatctccactaggtgttcatctcatttcctttggatatatactcagaagagggattgctgggttatatttttaacttcttgggaaactgccatactgttttccataaggactgtaccagtttacatttccaccaccagtatacaagtgtttccttttctacccacccttgccaacacttctccctcgtctttcataccatcaccaacctaataagtgtgaggtaaaatctcatcgtggattttatttgcatttcccttatgattagtgatattgaacaacttttcatatacatgttggccatttgtatgccctctttggagaaatatctattcaggtcctttgtacattttttagtcaagttatttatttgtgattgaattctatatgttctttttattttggatataaaccctttgacagatatatggcttgcaaatattttctccaaatgagtaggctgccttttcatgttgttgattttttttttttttttttttttttgctgtgcagaagctatttggtttgatgtagtcccatttgtttatttgtttatttttgcttttgatgtcctatcaaaagaattattgccaagaccaatgtcaaggagcttttcccctatgttttcttctagaaattttatgatttcacattctacacataagtctttaatccattttgagttgatttttgtgtatttgtatgtgtccaatttcattgttttgcatgtggatatccagttttccaagcaccatttgtttaagagactatcctttccccattttgtgttcttggggacatggtcaaaaagtagtagactgtatgtacctgggtttatttctgggctatctattctgtttctggtctatgtgtctgttttaatgccagtcccatagagttttgattactatagctttgtaatataatttgaaactacatagtatgaaagcttcaactctgcttttctttctcaggactgctgtgtctattctgggcttttgatgattacatacaaatttagaggttttctctattctgcgaaaaatgctattggaattttgatagggattgctttgaatttgtagaccacattagggcagtacaggcattttaacaatatttattcttccataccatatctttccatttattcatatcttcaatttctttcaacaatgttttatagttttcagtgtgtaggtcttttgccaccttggttaaacttattgctgattttattctttttgatattatcataaatagtatttttagatgttttattgaataggtcattattggtatacggaaatccaactgctttttattagttaattttatatcctatgactttactgaattcatttattagttctaacggttttttgtggagtctttagaagtttctacatataggatcatattatctgcaaataggaataatttcatttctttttttctgatttgaatgccttttaattgctttttctttcctggttgctcttgttagtacttccagtatcatgttgaatagaaatggtgagagtgggcgtccttgacttggactggatcttagaagaaaagctttcagtttttcttgattgattatcatgttagctgtgggcttctcataagtggccttcataatgttgaagaaatttttatctatgccttatttgttgagagtttttatcattaaacaatgttgagctttgtcaactgctttctctgtatctactgaggtgaacacgtggtttccatctttcattctgtatcacattgacttgcatatattaaaccaaacttcaaccacaggaataaatcccactttgttaagacatatactctttttgatgtgttgttgaatttgggttcctagtattttattaaggatttttttatctgtgttcatcagcgatattggcctgtagttttcttttcttttggtgtctttagctttggtatcaggatgatgctggcctcataaagtgattttggaagtattctctctatttagatctttgagaagagtttaagaagaaccaccaataattattttttgaatgttgagtagatttcagctgtgaagcccttttgtcctgagtcctggtcctggcatttctttttttttgggaggtttatagctattgcttctatccttttatttgttattggtctgttcaggctttctattatttattgatggaatatgggtaggttgtatgtttctatgattttatccgttttctctagattatccaatttgttggtatatagttcttcataatagttctttatgattctttttatttctgaggcatttgttgaaatgcccccattttcatttttgaagctatttatttaactcttccctcttttttttagtctagttaaaagtttgtcaattttgtttattttttcaaaaaattaactcaattttgtcaacttttctatagtttttctattctttaattgattttcttctgctttgatttttattattttcttccttttgctaatttcattttgttcttttcttagttccttgaagtgtaatgttaggttatttatttgagaccttttttaatgtaggcatttattttttattatgattttattttattttattttttgagtcagggtctcactctgttgtgcaggctggagtgcagtggcataatcttggctcactgcaatctccccctcttgggttaaagcaattctcgtgcctcagcctccctgagtagctgaaattataggcacatgctaccatgtctggctaatttttgtatattttggtagaaacgggctttcactatgttgttcaggctggtcttgaactcctgacctcaagtgacgcacccatctcagcctcccaaagtactgggattacaggcatgagccatcacaccctgccattgcaggcatttatcattataaacttgtctcttgagctgcttttgctgttttcaaaggttctattatgtttgttttcttttttgtttgtctcatgatatttttaaatttcccttttgatttgttctttgacccatgagctgttcaaaagtacatgatttaatttccctgtgtatgtgaattttccaataatccttctgtaggtttttagttttataaaattgtgatcagaagaaatatttgatgtaatttcaatcatcataagtgtgtctatgatctacattttattatttttttattaatatacagaagttgtacatattttggggatatatgtgataatttgataaatatatacaatgtataatgatcgaatcagtgtaattaagatatcacctcaaacctttatcttttctttgtgttataaatattccaattcttctcttccagctattttgaaatatacaataaattaactttaactgtggtctccctactacactattgaatactagaatttatttcttctatctaactgtatttttgtactcattaaccaactcccatcatctctccattctccttcccagcctctggtacacactaatttttatggaatgacacatggatctgattttttacttatttttatatgcatgtggattatcatattcatttgtttaaaaaaatccttgaccatttgttgaaagattatacatttttaatatatatttttctttttcatgtttgtcaaaaatctgttctctatatatgtattattttcagactgtatattttgttcctattttatcaatctattttattgattatatccgaataccactctgttttgattactataatagtttttcaaatcaggtagagctagccctccaagtttgttcattgtacaggcattttggttaggctagttcatattaattttaaaatcagctgatcaatttccaccagagatgcttgctgagattttgagtggaattgcattgaatttatagttcaaattggggaaaactaacatctcaacaatatttagtctcctgacccatgaacaaataatgtctctctagtttttaggtattcattatgttctctgtgcaacgttttgtaattttcaatcagatttatccctatgtgttttatatgtttgatactattgtaactggtattgctttttacatttcaattgtgcattggaattacacaaaatagaattgatttttgtctattgatcttgtatcctgctagaaacaaatgtttttcagattcaagttacatttggcagtgacaatatttttagggtcttgtgtatttaccaggtgaaaagaatcttttttatttcacttggagctttatcatcagcccaaggaagaggaacccatatcaagttctgaggctgggcagagtttgtaccttgtggaccaatgcacgtgaaatgttctgcatgtttaccaataagttttccttaagagtacctatgcagttgatggggcttcccatgtgcatgtctgtctgcaatgttacatttgtaaaatttagaagccaatgttatcccttattttcaaatttagtattcaataatctatcccagagttacgtagtgtcagagactttgggatgatcttcagtgatatatccatcaagttatcatgagtaggtacctgatcctgactagtcttatttctgatgtgatctattataaaatgagaccagatctttaaaataactaataataatgggcttgagagggtttctttgtgaaatactcagccttaggagacagtagatcctactccacatgcgaagtaggatctactcccttcagtatgtgagcatcaagaccctgattctgcagtggagtctgcagtctcctgctgtatcagcctcattccctcaagggagaatgaatggccttcagtttgttatgtcacaattgacacgtgtagcacatttgagtacctctttagttattgacctagatttatgtccaatcatgtcaagcttgctcacctgggtgaatcacaaggtcacattcccagtgggtcatttgactgtgtcacaaaaaaaaaaaaaccaaaaaaaaaaaccattcatttgtcattacgtatctctcctaaagttcaactttgataggctaaaacatggcccacaaacagctttaagggtggtttcttaaatgtttgtctgtggtttactaaagtcctattactcaaatgaatttatcttttactccagttttttgtttctccatgttctgcctctatgacagaacccaaaagtcagtataaacataaatttattcccactgatttataaccaatcaacagtatgtatgtgacatactgtacattgggttgccagccttcttccttcttttacctgtttcctattggatggtaagataatatgggtggggtttgatggctcaagtttgtaattccagaactttgggaggctgaggtgggagggtcactggagtccaggagttcaagaccagcctgggcaacatagtaagacttcatcttcttttttaaaaaataaatgttgtaatgttatttgccacttttattaacatccctggactacagttctaccacttgtttaaagcatacattattattataagatgtgcttaaatctgcatatttgtaagcatcattaatattattaatagttaaaatctatagtagtgaattatttggttaggtcagagactaaagtctgaaaattagaaattcactatttctttcaggtgtatgtgtgctgttgtgctaatccctcacctctgtcggaaaagtcattgtgggcccaagccagtaagtaaactgtctgtgaaagaatgaatgaagatcctaaaataaatatgtggtgcccactgagtggaaaattttgcaaaagttgtttttctacaatggtgtaatgtttctctgagccagctcatctgttccttcaaaggccccaaattattattttttttatcatcttatgtcattgtcattaactccattctgcccttgcctatgtcatctaccatgctatctgtttcactgcatggcactagagacagagccatttttccaactttaagtttactaaaagactcgcatctctgaaagaaaatggaagtcagtggttctctttgattttggtatttaaagccatcattagggtcaagtggaaatatgttttctccagaagttattaggggctgttcaatgcagtaacttttcacttcttacgctacaggtgatcccatctgtgatagttaatactgagtgtcaacttgattggactgaaggactaaaaatattgatcctgggtgtgtctgtgtgggtgttgccaaaagagattaatgtttgagtcagtgggctgggaacggcagacccacccttaatctggtgggcacaatctaatcagcttccagcgaactaaagcaggcagaaaaacgtgaaaaggacagagacgggcctagcctccatctttctcccatgctggatgcttcctgccctcaaacattgaaccccaagttcttcagttttgggactcggactggctctccttgctcctcagcttgcagacaacttattgtgggaccttgtgattgtgtaagttaatacttaataaactcctatatatatacatatatatataaaataaactatatatacacacacatatacatatatatatatatatatatatatatatacacacatatcctatttgttctgtccctctaagagaaccctgactaatacagattttgctaccaggggtggttctagaggaacagaatattaaggatggagtttttcattggttttggggtttctggagttggctgcttaatattattggacccaaaatgctaaggactctacttctaatagtatggaaaacattgatagtcttctgtgcaaacagtttagagagttatgcaaaatagatgcatttgacactcatgattcactgctcatgagaggcaaggagtttagtgactctatacataatacctttgaccatatgtgaagaactaaggaacataatgaagctggttagttgctcataagttcagtggacaaagtgatgaaagaaaaggatgaactcagggattctgtctcccagcctcagaagcagacactgcacctcaaatctgctaacactgccctgagtgagagtcttatatcctgtagataaaaagctgaaattgtggaaaaacagacacaagcttgcatcatgcgattggctgacctgcaatgaaagatgagtgcacagcctagccaggtgtctaccgttaaagtgagggcattgactggaaaagaatggaaccctgcaacttgaaatggggacgcgttactcctagggagcacaatgccaagaggagaaaaatgtggccataagcctctgccccacaccccagagcccaagaaacaactgttggattagcaggaataaaaagtgcttgaagaagtgttagagacttacctttaacagttctttttaggaccaggagaggttaaggaaaaaggaccatttcatctaccgaaatagtaataattatattcttctgcacattcagtttacaaagggttttacatatattatctcatgaatatttattgagtaattaattttttggacaccatgataagcactggaggtacacaggtcagtgaataagatttcctttaagacctcaaacttgtagaaaataagtgctcaaaaatatacttttatcagaatgtgggaattgttctaacctctggatattatagcaaggtagggacagggcacataggatgagacattttttcctaatcagaggctggaacattgagaattctcaaaggcaatcccattctcatcacattctcatcccattctcatccacaggaggatgtctcagagaagaaaggatggcataaggcagggtcttctctaaggaagagtctttgctacaaccttagagagtgtagagaatctcccagaggattactgggataatatagggagctaaaaggaattcaaattggaaagaaagaagtaaaattacttctgttcataggtgacataatctgaaatgtagaaaaacactaaagatttcacaaaaaactattagaactaataaatgactttagcaaagtagcaggacacaaaatagcacacaaaaataatttatgtttctataccctaacaattatcaaaggagaaaattaagaaaataattttatttacaacagcatcaaaaaatgtacataggaattagccaagaaagtgaaagacttgtacaatgaaaactataaaatattgcagaaaaatattaaagaatgcatgaaaaagtggaaagatgtcccatattcatggattggaagacttaatattgctaagatgtcaatactacccaaagtgatatacagattcagtgcaacctctagtccaaaattccaacaacttttttttttgcaaaaatagaaaaatccaccttacattcatatggaatcttaaggggccctgaatagacaaaacgatattgaaaaagaacaagctgggtatggtggctcatgtctgtaatcccagcactttggaaggctgaggcaggaggactgcttgagatcaagagttcaagaccagtctgagcaacatagcaaaaacttgtctctacaaaaattttttaaaaagaacaaagttggaagactcatatttcctgacttcaaaatttaatacaaagctcaagtaatcaaaacagtgtggtactaacacaaagacatatagatcaatggaatagaataaaaagcccagaaataaatcctgtatatatgatcaaatgatttctgacaagggtgccaagaccattcaatggggaaaagacagttttttcaacaaatggttctggggaagctggatatctacatgcaaaagaatgaaagtggacccttgttaggctgcccctttcctggtccacatgggctaaagagagcagacaactaactcactgtgtcattttttgaagtctgaagtttctgcccttttctcttcatctttcagagtctccttatgtttattgtatagaaaatgtccagggttttatttctacttactggtaggaatagggaaaagcatgcctattccatcttcccagaaatgaaagtcactctgccagccttttcgtttttgttagaaaaaagggctcactctgtcacccaggctgcagtgcactgcatcattgctcactgcaacctccaactcctgagctcaagcaacagcaatgcccttgccccagcctcccgagtaggtaagaatacaggtgcgtaccaccacagctggctaattttttttttggagatggggtcttgctatattgcccaggctggtctcaaagtcctggcctcaagcaatctccctccctcaacttcccaaagtgctgggattacaggcatgagccatcatgcctggcctcagctttttaatgtaagttcttatttcaccttcactttttgaaacgtattttcactgggtaaataattccaggttgtaggggttttttttctttcagtacttaaaagatgttgctccactgtgttctagcttataattgttttgatgataaatctgctatcacccttatctttcttcctttgtacataactagttgtttctcctctggctgcttttacaatttttctaacgggttttgagagattttattatgatttgccttcatttagttgttttattttcttatttcttgtgcttggggttaattgagctacttagatctgtggctttataggttccatcaaatttcgggaaatttgggtcactatttctactaatatttgtcctattcctctcgtacctcttttgggtattccagttgtcttggtccatttctgcttctataacaaaatatcacagcctatgcaattttgaaataatagaaatttattttgtgcagttctggaggctgggaagccctagatcaaggcaccggcactggtgtctagtgagagtggctcttcactttcaagatggttgcttgttgctgtgttcttacatggtagaaggcagagggcaaaaaaggccaaaactctgtgtgaagcctcttttataaatgccttaatcccattcacatgggaggacccctcaagacctaatctcttcctaaaaggccccaattaataccaccacaatggagattaagtttcaccatgaattttggaggggacacacatagtaccaattattatgccacttgaagtttttccacaattcactgatgtgttgttcatttttaagccctttttcagttttattttgtgtagtttctattcttacgtctttcaagtataatctttctttgcaatgtctaatctaatgttcagcctatccagtttacttttcttctcatgatttgtagttttaatctataaagttcaatttgggtctttcagacgtgataaaacacacttacatatttatatatatatataaacatgtttgcttttttctccagcttttgaacttataaacttattattgtttcaactgtctgctatttctaccctcatgtaacagttctgagtcaatttcaattgatggatttttttttttctcataatggtttgatttttctatttttttgagtgcctcagtttttttccgatgtcggatatgataaactttttcttgtttggtgctgaacatttttgttttcctataaatattcttgagctttgttctaggatgcaggtaagttacttggaaacaacttgatcctatggctcttgatttaagatattagatcagaccatagacatgttgtattcatttcctatcactgctgttgacaaatttcaacaaacttagtgacttaaaacaacacaaatttattgtcttacacttctgtatttccacatccaaatgggtcagtaacgcaacaacaaaaaaccaaataccacatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccaacatggcacatgtatacatatgtaacaaacctgcacgttgtgcacatgtaccctaagacttaaagtatgatgataataaaattaaaaaaaaaagactactgaactaaaataaagccattgtgtttcttcctggaggctctgagagagaatccatttccttgctcctaaggctaccacattcctgggtttatagttctcttttctcatcttcaaaagccagcaacagcaagtcaagttcttttcatgtcctatcactctgacttccctcttgcacttattagattgggcctaactaaataatccagggtaatatttgcatctcaaggtcagctgattagcaaacttgattccatctgcaatcttagtttcccttcagcatgtaacctgggcaactaaagggctcacctcatttgtttcccatattttagggatccagtgcttggtatttaatgtcatttgaccccatcaaacaccctgtgtctgggcaaaggtcagtcctaactccacgtgcagagtaagcaaatgggcccaggggataaaatggctagtaatctcagttcaccttggatagttccgcttttcctcctgaactttagttcatctagtgctggttactatcacaatgttcagctccatctaaaaataaaatgccatgccttggctcaaaatcccctctgagctcagactggctcttcatctggtagatttccggactgtcatattcctttatgtcatccctaggtattctaactctagattgatcactctaccagatgaccaacagaacacagctgtgctaattgggagagacaaagaaacaccatcttcaggttggcacaaatgtttccaaacatctataatattctcagcctatcctctaacccccagaaatattttccaagatcctgttgcatccaacacccattccactacccaatcgctatatctaacttgtaagtgatccacaactattgtaatcaataacagagatttcccccccacccctcaaaaaaaataagttagagttgtaggttatagtttagagtatcagctggtctgaagtcagagtccacccctcaacaccatccaggtatacaggtctgtagtaatctccataactctttcaggtgttcgatatccttacctgatattctcatcataagctgtcactagcaagagggctttggaagatgtagtaagtggaaattagctcaggagtcgttgagaagtctgtgaaaccctactttgtgtttaaaatatcgcccggcatacagaccttaaaccttctaacttctgacacagaactctgcctttctacttaggaagttcttgagagacaggagcctccttcagaacacagctaagtgctgagagaatgctaactgccaggagagaacagagtggttcatcttcagtcaatgtacgtgccctggagccaagaaatgggttacagaaagggacgtggtactccagacctgcatatgtgattctggatgaacagtgaccacagaggacagaggagtagggagaggaagagactcatgatgtacccaaatcacctgtgtcatggttaattgtcaaggcaggggagaagggggtctttggaagagatactacaaaagactccaagccaaacgagccagaaataaatgctttagaaagcacatcagtgcaagtttgggccccgatgaaattctggtgccattttgttttcagtgactggggtacatgatgtttagaagaccattcttccagaggctgagttcataccatatcccactttttacctctagcctggaggcaatctctggacttgctattgaggtttgaggtgaactgttctagttgatttctgtcacaggtcttcctttcatgtcctgctgtcttgcatttccactccctcagtaactcccctattcttctcacactccacattgtcagtcccttttcttccttagttcaactcagttgactctttagagcagcaaaaatacaacagcttggttgttttaggaaaaaaagtccagaggccagctatgtagaaaccttgtgaaatgacggaatggaaaacagaaattatattttaatcatgtccctgaacaaggccatctcaggtgaatgatctgctgtcagaataaagtatataatgttttcatatatactgaagcatataatctgacagagaaagagaagtaggaagggtccaggatagcagtcctcaatcctagatgtctattagcattatctgggggaacttaaaaaatacagatgcctggaccccataccagagatttccatttaactagggtggaaatggattgaccaccaatgtttatagagtctccataggtgttatgaatgtgcagccagggatgagaatcattggtctaagagctcagctaatccagtacaggatgatagctaaatgtgcagccagcagagaaaatgctgaaaatcaaatcatgaagtctgcattcctataatgttggcatagcctgaaacaaaaagaagagaaaaagtaggacatcatttgtgtcccctaccccatgacttctttcaaatgtgttttcttgcagtttacattctttaggccctgagacaccaaggcaaacagaccttgataatataatcagtcatcaatcaataactcagatattattgctgtataatacttttattaaagttttatggaaaaaacccacaacatttctgtatgtatcatatcatataatttccaggtgtgtcagagtccagtgacaaattacgtttgaagaacagctttaaaatccactcttgtctgccactcctttatgaaatattgaaaagcagctctgtacctcagcattaaaggttacaaaaagcaccattaaaaagaggactcacatatttaattcccttcaaagtagtcttatctctcctttctgacagacacagagctgcactcattcgaaatgctgccgtgtaataccaaccaacatgctccaatgtaccaaaattcaaacaagtctcatttatgagacccgtgtagtgattaggactaaccaacaacagtgagctttggctgtcctaaaaccacaagctgggttaggtaagtgttttgtacaggggaacagaaaagaagtaagatcatcaatacctaatatatgacttaatgtaggtatcccttgaccatttaacctgacacctacaaaatccatagtgtttagtatttcacaccaatcttactgcaaaagtgctgtgctacatacaatcaattcaagttaactccaactaatattggaactaataaaaaattaatttgtaacaaagcttattcacttcaaagcacaactgagaaaagcaaatccagacaaagcccaaactagaatcctagagcgattccattgctaagaattggactctacaagtaatagacttgagtttttctcttttttcccttctttcttataatttaaatttggctttttactctaaaagtttgggttcattgcagaaatcacagtccttccatatccaattgtgattggcacttaaggagagacaaatgcttagatccaaagagttttgaaagaccctaatggctacccctcccaggtcctgcattccatgggtaactggagtcagcagcccctggtagaagacagcaagaactgggctttaaggggaatcacaataatgcaggaatacactgtacatctgctattaagcccatgccccaaatcactagaacgtgagaatgtagaaatctctgagaacacaatgtatttcaaacacacacagagactattgcatatcatttttagttgaggtcaaaattattaaagccctatttccccaattaaaagcaaggagttctattagtatgtcttcttcatttatatcccagattaatataaacccagtctagaggtatcacttctttccaaacttaacttcatttcagcagcatacatggaatattgacacttttcaaagtttttatcccagacccattagatctacaagatactagaaagaattagagcaaagtgagtgggcctgggtttgtaggatcctcacaaacttctcttggattcttcttttacaaagtttctctaccatacaaacatacgttttaaaagccaacactattgaggttaggtatgcccttcaggggtgttgcctagaatggttaaatcccattcagcttaaaggaggctaataatcatggtgtggaatttctccataccagcagcatggctaacgtatgtgttttaggtaatgtctgacactctggtaaagtctgcctgacacatgagcttaaagcagaatggaaaggaaagaggagagaattggaacaagatgaaaagagaagatggttatacactgctaattctgtacagtgagatccaaggacaccaccatgtggtgtctgatttaatttctttttaaaagagatcattttcagttctaagttactcaaccctttattctattattacttctcagctcagtcactcttctcttccccacaattccgaaactatgttgaagttctttaaaggtcggccctcctgaagaactattttcttattctgcctactttgactctgtaaaattcccaaaagcaaaataaaggctaaaaaaattttttttgcctttactcattttcaaaatctgtcaaactctcctcagcattaaattaattatccctttaactaatcaatatacaatgataaatgagtagtactttgggttacttccttctcttcctccctctcttccaaatagactgagataaggcttctcagaaccatgggatgtatcagcagtatagaaaagggacagtgctgaatgagtcagcacccagtgcctcctacccattcccttctataccagctggtaggctcccatttcacatctgggctgagagttacctcagaacttgggaaactgacactctctgcacatttccagagagaaagatctgaagatcactagcatcaaaacctactgtcacagggggctgacgcatttcacaaaagcctcaggcctgaaagaaatcgaagagatctcttttcctgccccactctactgaaacacctgtgtggagtaaaaattttcatacatgaacacatacatattacatttcaatactgttgacaagaaatataacaaacttcatgtaataaccaagattttgaatcttcctaagtggcccacttatttaatgagtattggataaaaacaaaattctagtacaactgaaggctgtaaatcctgagagttggttataataggatctggcctggatttttaaatggcacaccattcaaaaagtggttgggaacataaaaggttctccacaaaagccttttgctgcagaaggtggccttggatggctaaagtagtatttactcttagcaattaaccaccaaagcatttagttatttgcatcccagcaaaacaacaatcccacactttactccatcacacctggaatccaagaggtctacaagtccaaagacaactgtgttatcagctttgcatgggaaagacaggaggtagctaaactgacctgtaggtgccctttcagtgtggctagggtcatctgagcagtcagggagtctctcattcatcaacagtttagcctcctttagtgttgattatttgacttatctgcaaaatggaagagccccagctacttgggaaaaaatgttttatctctgaaccccaaaagtggattgaatacttttcagtccacaaatggaattcagtgaccccacttaatcatcaaacacctttaaaaagaagaggcaggagaacaaaatgattttgttaacatttggtgcaaagaatgatacttttcatggttgggaatactaggaatactctcttgcttcttggcctaacaaatctttaaaatgaggaacccctttaggtgcatcaaatgagttaaatgaacttgagcagtttatctagagcagtgtttagtgtagtgatgtgtacagggttggccatattaatctaagaatgtggaaggctagactagagaagaaaatctctttgaagaagcatttatcaaaagcctgaaattctccaatgcggtctcttaagaccaatgaaaaggcattttttaattaaaaaaaaaatgcaggcacataaaaatctttcaaggatgaaagacatgaaaatactcccgggttccactcctgccttcagaactgtttactgagaaagaaaagacagaagcagggccaggcaaagtgggaaaactttcgggaatttgccaatacagcctgagccttggcaccaaactaaaacaaaaatgtaggtgttctgcattctgcctttcttataatgctgaaacatattttctttagaagttaaaacaaacacgacaaagtggcctgggcctgtgctgggctaaaaaggagaccttctgatagccctagtgtctggggtgggtcaggtgccacaaaacttttcaaagtcacttacccaataagttttgtgttagagaggggtcaggtatgggatctgaaggaggctattaaaggaagaatgtgaaatgagaggaataagggttcttgtggggcatctggtatcatataaacaacacagattgtgccacatactctgggaatatagagaacccatgcaagaaaaactgcccttgcaatgaggcagctgttaagtagggcagcggtctagcacaagcccattccttggagagccaaggtagcagtgatagaatctccacccaacaaggatcctaagagtttgctgttctttcattttaggaaaaatcttcctatatagttattcctgcagcgcccccaaacaggtcttggtgaaaacccacaggcagaaacaatacttctagctggggctaggaggcttccatttaccttcttctcatatgtatatttttttttcttaaaataaattccgtgaactcataaagctctcatctgcaatcaaatgcaaaagcagagcatcctactcagaggctctgaaacacacatatcagcctcaaagcaaatcagccttccagtctcaggtaagactggttcagtccagaaatgcaagggagatgcttctcctgaatccttagaggcaagaagggatcccttcaaatgggcttgtatagcagagtagtaacatacttcttcttgtagcgatgggttgcgctaaggaccatcacactgtcctgcaaggaaaagaaacatacgcagctaattcattacttcagacagtaggtagctcttcccagtcatcagtccttcacagtcactcacttttaacagagatagtttgatataagagcaggaggtcaaataagttttagttccaattctgactcctatcatcattctacttgtggccttgggtaatctacttagtgtgtccaagtctttttatctcatcattacaaaagataacacctaccattaaggttgctctgatgattacatgagaatatctgacacagtttctgacacataaaagggctgaagaaataatagtctcctaccttgctcccttccctactttaaattctaatgttgggcctaaaactagcaagaaaaacaaaaaagaacaaaatattctggcatccatttctagaagaaagtcttaaagacaatgaggaaaaaaagaaacaatccttctgaaaaactatttccaagtcccaaagcaggtctaattttcatttaaaaccagggatgacttccaaaagatctctctgatttagagggaacctaggaatccctctctatccttgaacaaagtagatgtcaaaatcctcttcagaaagacacccaatccaatggatcaattccaaactgcctaaacaatatgagagaatcaggaatgggtcagaaccaagctaagccacaataatcaaacaccttcacctgagtcagaaccagtaagaagacagcaagaggtaccatttcccaggctgtgttgtagactacagatgtaccacaggaggagatggcaagcctaggcaaattaaatgacatccaaggagcagttacaggaggcaaaatccatcagatcccaaagaacccaagcaaatccgattaagaacaagtgtatccttctaccttcccccgtactgtattatccaccatgaatgcttctcgggttaacactccagagtcatgctgacacaaagcctaaatacgacagaagcaaggcaggtaaacaattcacttttacacttccacaggttttgtggaaatgaggaatacctgagaaaaacctacttggaaagacctggcataatgataatataggaaagaatatgaagtcagcataggaggactggacctcagcagtcctgtctctggtacttactggcaatttgaccttctctgagccttagtttctttatctataaaacaggagttaaaaatacttacaacgttattataaaaattaaattcaataatatatttttaagtgttatattgtaccacatagtttgttagctatatcagtgatttcccgaatccagctatatatccaagtaaaagcagcttaaaaaaattatagggcccatcctagatgcacttattcagaatctctaggaatggagctgctgaatctgtatttttacaatcttctccaggagactctaatgataatcagcctggtttgataactgcagagctatataactttattccaatagccaaaccacaaagacataacaagacagaacagaatggctatttccaacccagactctaaagcagcagaaaaaccaaggaggactctagagttgacgggacagggcaaatctggtcacatctctcctttaactagtgtataggagagatgcaagcacctgagtatatatgaatgaggcacctgaaagtagctcaattccaccttcaaaaaatgaaagccttaatatcacattcaagcattctttgaactggaagctaaacctgctttttctgcagaagaaatcctatgctatgaacacaaacttaagtaaacagttagtgtaaagattctagtcacccaaaaaataactgggcagcaaaaaagtcctatcagagggcaattcagccagccagaacacagagactgagattttaaaacaaacaacctagtagttaaaaaaaagagagttcttctataatttgatcattactgccagcttcagcttcaatgaaatagcagagaaagtaaccactgagaacgtatgttacccttgacctctcattccagggagctctgtgaagagccagggccaccacttaccttaatggacaatgcatagagatggttcagcataacatggttgggctcagggagtaaggctgggtcacactaagagaaagagaaaaaaattactaaaaaaattactaaatgaaattaatgcacagacaaaccaaacagcttactcttcctcagagctctttgagaaatttaaactagaatgcgctatctcttttcaataatgcacccactctagtatgtatcaataatacaatcctattacagaaaattagaaaaattatcagtccagggcagaaatctcatgcctcagcatctactaatcttccttaagagagctaaaacaaaaatcttgcccacaacacacaaggaagagttgtgttacaaggcaaaaacaatcatagtaggaatcaagtagattgaatagagacatgaattatatacaaaaaagctttcatagttcttttgtacacccccaaatgataactactcctttatgttgtgctcaaaagaagtccatagctctgatcctgattttattaggatgaggagacaactatgaatttttatatcagtacctgaaaaagctgtgactcaccactggaaaaaggaaatctgtaatgttattggtatgtgtatgacttataatctcaacacacctctgtagtaatcctaacctctaggattactgaactttggtccaaatggtcctagacacccccagatgccccagtaatactcaggatactcacagaaatattagtgtctttgttaagaataacttgaagtagatgaggaggaaggatgggtggggatttgaatctttcctcagatcgaaacgcatacatttcttgaccataaggccctgggggtgagctggaaaggtctgaaagatatttatacaaatatgagaaagagttggagaattagcaagaatgcatggaaaaagctatcaatacatggcagctaacattaaatatggtagaagtcctggatcacaaacttgtgacctgtgggatctacagctgtaaggtaaccagaggaaaaatctgagtcccctggacataaaccatgaagctcctcaacatagcaacatgatttgggagacagacaaagatataaagactcaaagacccaggctcagggaagagctactacatgtatcagctgtaggaccttggaagaatccctccacaatggtcagtttctttataaaataaaaataatctttgccctatttcatgatgtttttaaggaaatcaaattagataatggatgtaaagatgccttgtaactttcaaacaatgggaaaagattagattttttcttttttccagccaaacaacaaggttataaactcctaagactaccaatacaacaatgattgcaacaataaggacaaaatgtatgtaactgtcattagggaaatgcaaatcaaaaccacaataagctaccatttcatactcactaggacagctaaaatcaaacagacagacagtaataagtgtcaacaaaggaatggagaaattggaacgctcacactattcccactgctagagggaatgtaaagtagtccagccactttggaaaacagtttggcagttcctcaaatagttaaacataaagttaccacatgacccagcattatacactgggtatatacccaaaagaaatgaaaacatatgtctacacaaaaacttgtacaccagtgttcataatagcattatttataatagccaaaaagtggaaacaatcaagatgtctatcaactactgaatggataaacaaacagtatgtccacacaatgggctcttattcagccataaaaaagagcgaagtactgatacatggttagaacatggatgaaccctgaaaacattatgctaagtgaaagacgccagtcacaaaagaccacatattgtaggattccactgatatgaaatgtccagaacaggcaaatccttaagacagcaagacttgtggttgccagggacggaggggaggagggaatgggatgtgactgctaatgggtacagggtttattctgcgggtgataaaaatgctctggaattagatagttgtgataatcacataactctgaatatactaaaaattactgagttgtacaatttaagagttaattttatgatgtataaattacatctcaaaaaaatgaaaaaaagtatgcagacaagaatacaatatacaaaaatgaagagaaatatattataatatattttatttaaatgttattgtttcttttttgagagagggtcttgctctgtgtcaccgagtctggagtgcagtggcttgatcacggctcactacagccttgacctcctgggctcaagtgatcctcccacctcagccttcagagtagttggtactaaaggcacatgctaccatgcccagctaattttttgattttttttgtagagacagggtctcactatgttgcccaggctggtctcaaactcctggactcaagtgatcctcccacttcggcctcccaaagtgctaggattacaggtgtgagccaccaaattcattgtaagaactaagttccagtgttccgttgcacagtagagtgaatataggtaacaataatgtaacaaaataaaatagctagaagaaaggattttgaatgttatcaccacgaagaaacgacaaatgtttgagatgaatatgctaattgccctgactcgatcattacacatataaaatgtattgaaacatcacattgtatctcataaatatgtacaattgttatgtgtcaattaaaaataaaaaatacatataaggcaaaagaaaaaagcagaagtaatactctgatattaaataatatctttaaaacatatggaacttgaaaccttacaaagtattatgctttgttatttcgtcacatgatccacaaaatacccttgggaagtgcacagaatagtttttattgccttttcaccagaaaaaaataaatacaaattggttatttgcctaaagttacatacatggatagacagtaaatgagtgcagactaaaatccattatctgtagattcctagtaaaaaatggattataagcgttacctcaatagattgggaaattaggagaaagggaaatatcaaaagtatgcaagtcttctctctatataattatgatacatgtctatttattggttactttgccagaattatataatgcaaaaattagtcacaagtatcctcataatctaattcagcattttaaaacccttttaaattactgtcccaccagtcaaaaataatgcccaatttaaccttctgagcttatatgatgaaaacaacattttcaaaagtttcctcaacagatgattacactattaataatagtctcgctctgtcgcccaggctggagtgcagtggcgagatctcagctcactgcaagctccgcctcccgggttcacgtcattctcctgcctcagcctcccgagtagctgggactacaggcgcctgccaccacacccagctaatttttcgtattttttagtagagatgaggtttcaccgtgttagccaggatggtcttgatctcctgacctcgtcatccacccgcctcggtctcccaaagtgctgggattacaggcctgagccagtgtgcccagccaataatttcttttaaaaacagcaaagccacccttctcccctgaaattcaaatatgttccacttaaggtattgtgcctcctcagctgagaatcactgaaagtttaagtccctggttttactgtgaagaaactcagaacgaaaaaggttgagagatttgttcatgatggcaaaactagttagtagcagaggcaggctttgaactcacaggagagaagtgtgctcactgggaatactgtgcacaattctttagatagttcttattgtaaagtaacaaaatggtaactacaagtgtggttagcaaaatattctctgatactatagcaattgtaagcagagatgaaggccttggctcaaataatattagaggaaataaaagtgtaaagatattttccgctaccatagacttttttttttttaaccaaaaatttacaaaatttcaattacctacaacagaattgtcagggggcaggggggtggttgtcttgtttttgaggcagtatctcactctgctgcccaggctggagtgaggaggctcaaacatgcttcacagcagcctcgacctcctgggctcaagcaatcctcacgcctcagcctcccaaattgttgggaccacaggcatgtgccattacgctcggctaatttttaaaaattttttgtagagatgggtcttgccatattgcccaggctgttggttttttaaaccatttttttccccacattttttggacctcataaaatcatgaaactgctaactgaggtctcaaactggcaggattaagatggggcaaaccaaacaaactacacacatgtatcgcctctgctgggtaatatcatcaaaggtcagtggaaaacttgaaatattactagaaacagcttttcaaactataggctgtagcccattagtgattataaaagataacatggaaaatagagtgtatcccatgtaataaggtaaacattgtatcatgagacttgtgttacaatgtgtgtgtttgtgtttgctgcaaataagagacctaaatgtttacaggagaaaaatctctgtctctctctctcctccccccaaccccctgctctctctctccctctatatgtatatacacacataaacaacttttaggaaggaactacaagaaagacacagcaagagagagtaaataatacaaaattacctctacaagatgtctcagaactttccatagaatctaactttaaagcatcgaacacctcaaaatcagatttcttgacatggatcaaattgttaattgtgccaagctgactggtaaccacaggctgaaacagtgaatagaaaaaattattgaatctctctttcaaatccatctcttccatccaaccttcctcttttactaaaatttacacgattgttctcagcacctccacgttttatcaagagagaaatcctccagtgtaggggagcagctgcccatcagtcttgacagaaatgacagctaaaatgagactgctaagtcaatggttacccttggagatcaaggccttacctctgatggatcatgaacccactgtccatccacaaagaacttgtattggtgctctccctcagggaggtccaggatggcaacaaagtcattatggctacagaagaaaaaagaaaggcaaacaggccaagttccttttagaagactgaatctaaaaaacaagtggcaatcatagtatcatatgaataatttcccagattcctaagccattgtatcccctggtgtaaaaaacaacgtataaacccattctccttttctgtatcatcttggacatgtatttaccagctcctcccaacaacgttagttcttaaccaatatctggaaaagaataataaaaacattaatcccctcaaatggttcaccttagtataacttactttgcttcagtagaacaagttcctcaccagtgcaaataagataggtaggtttaggatacagaagtgcctcaaggtactctttccctgttttggtgaaccttttctagagaatgaactaccatacaaagggccattctgacaaccagttaaatcactcattattgctttggaagcaacaaataacatgactacctaaaaattcaaaatgtgttttgctttagtgcagaagtcagagcaacaagactcagacagttacaaaagacttcccacaagcatagacaggacttgtatgacatagtcctaaagaatgtagccataaagctattatgaatccctctgaggcaatgaaattctaaagggtaaaacatctctgactcactatgaggttaaaaaaaaatcccacagatatactaagtggccgcagaaaagggcatgttctagagacagtccttagtaggtggagaaaagtccagctgggtctctcttctgagaaaagaaatcaggtctctattcctggacccttagattcaaccaagacacttgtcacctcttaatcagtggaatcttggtgctccaattgttgaaggacccagagatgaagacctccttgcctccttcagaccagcggataacagtgggccgggcctgctgtgtgggctttacggagtcctccaaatcctgctgccatgatacaaactctttgtccccagggagctgtaagaaggagtaggtcatccctagaataaactgtgacccaagaattctaaaaaggtcactctcctccctaggatagagaagggtgctaggctttggctaaggatataaaccccaaaattagcaactaaatcagagtttgaacaaattatagaaaaagaactcatctaggaccaaaaatggtcaaatggcctatgctcaagcactgcctaaatcatagcctaacttttgagtctacctgtgtcacttacccttccagagccttagactctcccttaaaaaaaaaagaaaaaaataactccctaccactagtttaactcataggcaggcaattatgatatgcttctgagtctttcttcagaggaaaaaaaaatgaaaacaaagtatggttctgtaaaagataattaagtcagccatatatttttataggcaaatatgaatagctctcaattaccagttgtaatggaagtcagagatatcaaaattcataagtaattcataaactgtatttcagctaagaagtaaaaagaagaaacattaaaaattcaaaaactagatcactgatttcttaaaacttgagaagtggctatgaaatcttacttattcccctatcccaggcttatactaattatttcaggagtaggaataaaaattctagaacctcaagaagcaagagatcaaaaatacaatttcctttatcaaaagtagctctcttatcaaatgaggtttatgggattgtaaaaacagtaactcctgtttcttttcattactatcctttggaccaagagttggcagacagccagtaagccagatgcttttatcaagtgttatttgaaaacagctctgcccatttgtttacctattattttactgattgattgattgagaaaggaccttgctctgtcacccaggctggaatgcagtgagtggtgtaatcatagctcactgcagcctcgaactcctgggctcaagccatcttcccacctcagcttccagagaagctgagactagaggtgtgaaccaacatacctgccttgcttacctatattgtctatagctgcttacaggctacagtggcagaattgcgtagctataacagagactgtatggtctacaaagtctaaactatttactatctggccctttacagaaagattgctgacccctattttagactggtttaagtgactttggtaaataagactgtatagtattaagcctaaatattactaaattgaataatgtgggtttttttttaaaaaaaggactagcttattcatttgggctttcttttcaaaatggttgacatagcttccctccatacattctcttgatattcctcaaaactacagtatagcatatcagtagcaggataatccaaagtaaatagagaaagagaattgaaaggactttcacataaggaattgacttaagagaaaactacatattctcagaacaatgcactcttgactaactggctgcgttagaattacaagaatttgacatatgcctaagaataaccctcagattcggatgtaagatctgggaacctatttttaaaaagctttctagataacactgtgattatgttaaaataaaggaaaaaaagcttcccagatataccgtgattatgttaaaataacaaagaaaaaaccctcatctttagaggtacatcctaaaatgttacagataaaataatacttgatataatatctgggaatttgcttcaaaataactagtgggagaatagtggactggggtatagatgttatatgttcattcaagatatgatcattgttcaaactgggtggcatgtatatagatgtcattatactgtttccccctactttgaaagtgtttcaaattttccaaaaactatttaaagaaatctgaggtgattctaatgtgcaaacaggattgagaaccactgaactagtccactgaaaaaggcaggcattcaaagcaaagtaggcccccctgccactgtttctgtcagttacttttatgacaggattttcagtttagaatttgaaagctacaaactattaatatgcctagctttggaggaaagcccttccacttatgacatgacatttctgtagtaggaatgaatgcaactgactagcagaaagattgtttactccaagttactcagcaaaactaccaggaaaagaggcaaaacgacaatcagaactacagtttgatgtttaagtaaaatgttgagtttagaagtaaagaggctacattgagaactataaaattttagacttaaatgagaccttaggaattatctgattttcagacaatctgaaaattatatgaataattttcttaattcacaaatgccaagactgaggtgagagataagaataatacaaaataggccccaattcagacagagcaacctggcttttaatcaggacaccaattactgcagtcacagttcgacaaatacactgtatttaaatcctgagtcatcaacataggaaaagggtaaaaatataatgaggcggatcacctttcgaaagctttgaagaagtaaattcagatggcttgtagatagcccaaataagaatggagaattggagaataaaccccaataagtgctccttttaatcactctcacttctctgtgattatggttggtttttttgtttttttgtttttttgttttgagagtctgtcacccaggctggagtgcagtggtttgatctaaactcactgcaaccaccgcctcccgggttcaagcgattctcctgcctcagcctcccgagtagctgggactacaggcatgcaccagcatgcccggctactttttctgtatttttagtagagacggggtttcaccatgttggtcaggctggtctcgaacacctgacctcaaatgatccaaccgcctcggcctcccaaagtgctgggattacaggcgtgagcctctgcgccaggctgtgatgatgttatcaattgagatccaaagaaataaatcatggaatccaaattccatgtgctaccaatatggcaaacaatactctattcactctctaaagccccagttccctgggaagtgatgaaatgataggaaacatcaaacacacccgaatctcctcaagccctccatttttctatctcatccagtcagtctacctggaggaattacttgtatttcatgctgacagctctgaaagccattagaaacattagaatggtaatcgctgctatcagctccatctgtcctttcttacagagtgaaaacaagttgttctcttcctgaaagtccttggaattgagagcaaggtcttcagggcagctgtgggttgtcgtttttttagccacgcaacattttgaagtactactgaggagtaaacaagtcgtggaatcattggctcttccacctacggagcagcagcggggcgtgaaagaggcacagcctcagccaccacaactataaagtatgggacaaaaattaagcagtcaactaaatgatgtccttaattgatccccaagactaggagaaagtattcaataagcaagtagttgctgcttacagccgtgccaaaagggaagaggatcacaactgtagagctgctagaagagcaaaaatgatactgatacatagaaattttcagaaaaagaatttcatttagccacctcagggcaaaggtgagaaactaccacctatggtcagcaactcgtgcaacctaccctctgaagttgtccaccagggattacaaactacaaattcagcaacgctatggaagagagccattcgtgctcggaggatcggggatggggggatgtctattgtccccatcctaaaaatgtggccaacagattagtcagaacaccaggaaagcaagaactccgcctctttatcctattttgaggcggcacttcaagaggaattatcatccaacacctctgtccccgataaatccctttaattcaaaaaaccatagcccggttcggcgcggtagaaaagaaccaagaaagggaagaggagcccagaaatcaacccgctgcagtactgacaccaactgcgggcatgggacgcttaccttggagtcagggaggctgaacacgctggggtcgtccgtactccccaccatgatcttgtgctccttccccggggcatggccgcctgcgccctcggagcgtgcagccttggcgccgtggcgctccccggacacccggtcgctggtggtgtttcccatggctgcagctcgtcggggaccacctaccgcggggaacgacaccgggctgggaacacctcagccgccgcgtcaggggcgccccccggccccgcccctgcgcctcgggacagggcaagggattccccgccccagggaagccgagccctggagccctctccctcctggcctgcgggaacgcctgcaaataccccggtgccctcactggccctagctcaggaaacccgctatcgggacctcccccgcgtccccgcgctcactgccaggggcgcccccactccagtcacctcgggcgatgcgctccctcctccaagggccactgatgtgatggctgttctgcagatcaggccaccaataaagttattgaaattgaagccgcacccctcgctggcgaccagcgattcctcctaaaatggctacaaggccggcggcgcggagtccgcccagtgcgcgttccctgcggcctgcagcctcggcgcccgggacccgccggcctctctagccgccgccgccgccgcctcgatggtgggcagtcgcacgcagcctccagcgccaggagggggcgccaggcagggcctgtcccgcctggggagactgcgcccgggataataggagcgcttggcctctgagactacccggcagaagggacgtccccaaatgacactcggaggccgcctccctgggctccggtgctcggtgccgggaggagcggcacggctttctaccccgcctcaggtgcgccagcacgttttctgggcagcatctgtgtgttaggcgaccggagaggtgggttccttatagggaataagaaaactgaaactgacttccaactgcaggcagaaggaagcagtggtcattgctggaggttaaaactgttctgaccgggcgcagtggctcacgcctgtattcccagcactttgggaggctgaggcgagcagatcacgaagtcaggagatcaagaccatcctggccaacaaggtgaaaccccggctctactaaaaatacaaaaattagctgggcgtggtggcgcgcgccggaagtcccagctacttgggaggatgaggcagaagaatcgcttgaacccgggaggcggaggttgcggtgagccgagatcgcgccattgcactccagcctggcgactcagcgatactccgtccccctctccccgccccaagaaaaatctgttcagtggggagcgacaaggaaggagctttcagcccgactggggtcgcagggaagaattcaagatggcgtgtttaggagctctagctccttgacaaattagtaaaatgttagtcttaggagaagaacgaaaaggctctcctaggctaagaaacagcatacacagtgagaaacctcagaagaaataaaattcaaggaagatagcaacaacgaaaacatcagaaggaacactaaaggtataaaaagggcaaagacagccctagggttgggagggatccaggttttttatgaaaattagtggaatccctaagatacttacctttgtattataagtatttgcatgtctccttctagaaacgtttatcactctgtgttacacagaccagcagtgttggcgtcaactgggagcctgttagaaatgcagaatcaggccccatccccagggttctgaatctgcattttaacaagatcacattaaagtgtgtgagaagcaatgctttgacagctggcagagagcagatccagatttgataccttttcatattctgcatgtaccttatacagagtaggcttttgcatttgcggaatgaaggatacaggaatactgtttactgtaatccatttctaaccagatatgccacttaggcttaaacacggccaatgatggggaaccccaagttacataggccaccctttctgagtgagcagctctatttgctgaaacgttcatttttatattatgaagttgacatcccacttaagtacaacaaattcactactcccctattctttgctctgcctcttataaactcattctttggctcataaaccaaagacagtttacaggaagaaaaaaaaaaggtacgattttactgcaacttcttgctcacccctccaaaatctttatgtctgagtacatgctttttggttatccctacttttctccctccacccctcaattccttaccataggacactgaagcaaggcccttgaagatacataatacattaaaccttgacttgtgtagtattcagttttctgaccccaaggtggtttcaccatgccaaataatatgtccttggtatgtatttccttgcagtagtcaaatcagcctagcagaaacaaagtacgttaaccaatggaaaactgacggagagaaataaactgtttttgcacagctaaatggaaatgacttttgaattatctgctttggaagattatccatgacactgttctgccctgctctgctctaacaacatttgtaagtcactcaacagttaataataaaagtcagttttgaatattgcaggttttagacacagaacaaatgtaatgtgacactgtaggaagaatgaattctccttagtcccaaattccttttttttttcttagattcgggaataagtaaagatacaagatcctcttaaccagtatcagtataattgttccctttagatttattgctgtcaccccaatgctcttctttctttctagaggaaaggaaaagaaggaggtaataggaaaagtaatgggttgtcctgatgttactgtgtctaggatgtcattgccactggtctcctcagatcaatcattctgcctaataaacagaaaaataacatgggcagcctcacatgcaagcctttacacacactgctaaagagacctcgcttcctctgagaagtgaggatgtgagaatgaaggattgattttacagaactggatgacaggttaaattgggcatctggaggtttatattcccatctccactcaccaagtttcatcctccatttatgaccaaggataggtataacatctgatcttgatggttactgtttcaaaaaacaatctgatcttttttataaagttaaacatttacttaatcatgcagcatactaattcccactcctgggtatttatccgagtgacataaaaacaagttcacacaaaacctgtaaacacatatatgtctttattcatataatagaaaaaacacaaaccctaaaatggaaaaaacataatgtccttcacctggtgatatggtttggttctgtgtccccacccaaatctcatctcaaattgtaatacccacgtgttgaaggaaggacctataaccttcacgtgtcaagggagggaagtgattggatgatgggggcggtttcccccatgctgttcttgtgatagtgcatgaattctcaccagagatgatggttttaaaagtgtttggcagttcttccttcattcacacacactcactgtctctcccctgtgccacataagatgagcttgcttcccttctaccataactgtaagtttctgaagtcctccccagccatgcagaactataagtaaattaaacctcttttctttataaattacctagtctcaggtatgtctttatagcagtgtgaaaataggctaatacatctggtgaatcaataattaaaatgtagcatagctataaatggaatactactcagtaataaaagaataactcgatacatacaataatattgatgaatctcaaatgcattatgggaagtaaaagaagccaggctccacttatgtgacattctggaaaaaggaagactatacggtcagaaaacagatcagtgtttgccaggacttgggggtggggggtggggagtgattgactacaaaagggcatgaagaaattttgaaggggaggtatggaacaggtctgtatcttgactgcagtggagttattgatacttaccaaactgtacaataaaaagtaaatttttattgtatgaaaattatgcctaaattaaaaactattaataaaatcagcattagcaaaatatatgagtttatacacaagagactactcaaccattgggtaaactaattatttttaaacaaataccattgattttaatctttttatagtttttatacaggcagagaaataatagtgattctgctcacctaaaggaagatagacccaattcaaaggtacagaattttccccaaatagtatcataatttttcctttcagattccaaaggatttgcatgtaaattctatcatgtgatcctcagaaccaccctatgagggtaagcagaacagatgatccatgatattccattttataaatgaggtgcaggttaaatatttagccagtatttcttgataagtatagtccatttatttcaacaaaccttgattgagggccccagtacttgttgagcttttgctgagccacccctgctctagaggagcacatgctctggaaatctctaaggaaactactacaactctaaatagatatggtgtatagtgatactgtgactaaatattcactgcaaatttcctctaaaattatagatatacattactggaataattagtatctcaacatcttcattaactatgaatctactatgtatatatcatcaccatgtgagtattaatttggtacaaataggctgccaactctaaaattatttgatgtagggcaagtacttttatctttttagccataaattttctcatctgtaaaatgagaggagtaggcatgtgatcattaaatcctgggttacggtaggaggcatcaatatgaaatgtttagcttaatatagatacagatgggtaaatatagaaatacttaaaaatgcatgtggattcatgtttaatacattagtatacacacatatatttccaagttctgtcctccgaaggcctagaagcaatgacaagcagaagcaaggagcacacccagcatccagttttttgtttctaatactgttctccaacaaagggaaccagagcccttgagaaaaatgcctaattctaggactggggcaggggatatacaagatgagtctgaaacatcttatagtgccagaaaataaacaagtgctttaaaaagacacaaaaaactgatggtatatcaaagtgacataggagccaactaaaagagatcccaatagctaaagctagaataattcaaaaaataagtaattcagcattggatttaacccaaattataaaataagatccatgagttcatactgatacaagtaaatgattgaagaaacaaataattgggagataattctcatattgaaaaattccaaaaaatttatgtactctaccctcgagaagatggaacataattctccaccccataagcatgagtcgagcctagtaaatgtttttcaaagagcgcagtatggaaaggaggaagaacactacctcaaccagctgatcaaggctaacatctctagtatgtcattagtggcatgtaaccttgatatgatatgatgagaatagcatttgatctttgatctgtttcctccccgaaactcattgccccagcctaatcatgaagaaatatcagacaatctcaaattaagtacaaaataaccagtactcttcagaactatcaaggccaccaaaaacaaggaaagtataagaaactgtcacagtctagaagagcctggtgatgactaaatgtaatgtgatatcctggatgggatcccaggacagaaaaagaacattaggttaaactaaatcaaacttgagtatgaaacttctttttttttaagtgcctaagtcctgaatgacaacaaaagactgaagaactgacaacgattagaggacactaaggagacttaacaactaaatgcaaaatgggaccctgaatctgatcctggaacacaaaaactaaattagtagaaaagtggtaaaataggtggtcgcgcgcccgaccgccgcagtcccagtcgagccgcgacccttccggctgcccccaccccacctcgccgccatgtgcctccgccgcccagcgctgttcccgggcgtggcgctgcttctcgccgcggcccgcctcgcggctgcctccgacgtgctaggactcagggacgacaacttggagagtcgcatctccgacacgggctctgcgggcctcatgctcgtcgagttcttcgccccctggtgtggacactgcaagagacttgctcctgagtatgaagctgcagctaccagattaaaaggaatagtcccattagcaaaggctgattgcactgccaacactaacacctgtaataaatatggagtcagtggatatccaaccctgaatatgtttagagatggtgaagaagcaggtgcttatgatggacctaggactgctgatggaattgtcagccacctgaagaagcaggcaggcccagcttcagtgcctctcaggactgaggaagaatttaagaaattcattagtgataaagatgcctctatagtaggttttttcgatgattcattcagtgaagctcactccgagttcctaaaagcagccagcaacttgagggataactaccgatttgcacatacgaatgttgagtctctggtgaacgagtatgatgataacggagatggtatcatcttatttcgtccttcacatctcactaacaagttggaggacaagactgtggcatatacagtgcaaaaaatgaccagtggcaaaattaaaaagtttatccaggaaaacatttttggtatctgccctcacatgacagaagacaataaagatttgatacagggcaaggacttacttattgcttactatgatgtggactatgaaaagaatgctaaaggttccaactactggagaaacagggtaatgatggtggcaaagaaattcctggatgctgggcacaaactcaactttgctgtagctagccgcaaaacctttagccatgaactttctgattttggcttggagagcactgctggagagattcctgttgttgctatcagaactgctaaaggagagaagtttgtcatgcaggaggatttctcgcgtgatgggaatgctctggagaggttcctgcaggattactttgatggcaatctgaagagatacctgaagtctgaacctatcccagagagcaatgatgggcctgtgaaggtagtggtagcagagaattttgatgaaatagtgaataatgaaaataaagatgtgctgattgaattttatgccccttggtgtggtcactgtaagaacctggagcccaagtataaagaacttggcgagaagctcagcaaagacctgaatatcgtcatagccaagatggatgccacagccaatgatgtgccttctccatatgaagtcagagttttcctaccatatacttctctccagccaacaagaagctaaatccaaagaaatatgaaggtggccatgaattaagtgattttattagctatctacaacgagaagctacaaacccccctgtaattcaagaagaaaaacccaagaagaagaaggcacaggaggatctctaaagcagtaggcaaacaccactttgtaaaaggactcttccaccagagatgggaaaaccactggggaggactaggacccatatgggaattattacgtctcagggccgagaggacagaatggatataatctgaatcctgttaaattttctctaagccatttcttagctgcactgttatggaaataccaggaccagtttatgtttgtggttttgggaaaaattatttgtgttgggggaaatgttgtgggagtcgggttgagttgggggtattttctaatttttttgtgcatttggaacagtgacaataaataagacccctttaaactgtaaaaaaaaaaaaaataggaatgcggtccatggtttacttaatcgtataatatcagtgttcattttcttattttgataattgtcataatgttgtgtgaaatattctctttagggagcctgggaaagaatatataagaactctactgtttttgtaacttttgtggaggactgcaatcatttctaaataaatagtcttaaaaataactaaagtaataaaaataataaagtacatgaggaagtccagtgtcatgttgtatagtcagaagattcttcaaatgagagaatttgcacccagggaaatagagaaaaaagactctgaaaagaactttttttgtttgtttggtttttgtgttttttttttgagacagagtcttgctctgttgccaggctggagttcattggcgcgatctcagctcactgcaacttccacctcccaggttcaagcaattctcctgcctcagcctcctgagtagctgggaccacaggtgtgtgccaccacgcctagtcaatctttgtactttttagtagagatggggtttcgccattccggccaggatggtttcgatctcttgacctcgtgatccacccgccttggcctcccagagtgctgggactacaggcatgagccactgcgtccggcctgaaaagagccttaaaataagtttatttaaaattctcagagaaaggaagatgccagtttgaacacaccccagctccatgccatttctcacccctacccacccaattttcacaagtcagaagctattggtactagcagataatagagtacaataaaggcctaaggatcagtgagcggcctgacagaacagatacaggtccacctctccttttgactaaatcaaactttaccatacatcaaaattatctagagggtcaaatatgcagattgctggtctgtgtacccagagtttctgattctgtaagtctggagtggggcctgaggacttgtgtcaagtacaaggctgatgtttctgcctcaagggccacattttgagaaacgcggcctagacaagggtctagagacgagtattcaagatccccagtaaacggcattgtgcagaaaggagtttgctgactcttagaaccataataatgcttcgccatacctaaaaaataaacaattaaaatcaactaggatgtgtgggaacaagtctctcatacagaattccaaataatttatgtagctattgccccctcaaggaattagagcacaactccatgcttgtgactgctttagcttgcaagtttggcccatgggtgggatttgggaacttggattttgggaggtttcttaccaccttaactgataagagtggctcacttttttaaaactgtttgtacaaacaatgtgatttatgctgaacacttgcttttcttctgggagtctggaattctgatatgtgctaagcagagggtgcctatgtgactagccccaactaaaaacctcatcacagagtgaagatatgtgaaagtcttttgattgtttccattttcttagaggaaaaaaagagaagatgattagctgactgtgaggaaaggagacaacatatttgaggtttgaggagataggttatatgcagtaatcaactagaaaggtgggacagagaattgtctagaaaaatgaagtatgattggcagtagcactgaaggtctacctatgttcagtggttatgaatttcagaaaaggcaagtcaccatactagtatttttctcttgtcatgtttagctgttttgatgcaggcagataaccaaaatgaagtttagctaagcaagtatggaggagagcaacaaagtaattgagagtgcgtggtagggtgtgattataatgttgggccatgcattttaaatgaggtgggctgggaaatgaagacagcaggttgatgggcagcccagtggagtcaaagaactgctggagttggagtaccagagtgaatgaactgaaaaggtaggagagagttttagagagtgggatgcttgaaattgagactttagtggtgttgcggttattcatgacaatgtcttagatatgtccatgtgggtataggtagttgagatgaggcagattataaaatcactggagtaagaagatcacataactaaaaggccagatagcagagtgttagagatctacctcaacattcattctctcttccttcttaataacagaaccttgatttttttcctgaggtattgcctctctgtataaagacacattttgtagtctccctagtagctagataagtaactaagttcttccaataagactaagtgaaaatgttatgtggaacttttgtaaagtctccttaaaagaaaaggggtgtgccattgttacatttctccttccttctgtgtagaatgtccatataatggctatagctacagtgggccatcttggaccatgaagtataaggtccacatgctgaagatagtggagcaaaaagagaagctgaagaactgttatatcatctcaggactatctacttccagacttttttaatataagaggaaaataaacttaaatcttatttaagtcattgttatttgaggttttctgttaaatgtagctgaagctaatcctgactaagacattggattggtgaaagtattacctacatcagtgttaaaaccaactacaggagtagttttatattatagcgaggcagagagcttggtgctaaaatctttactgaatgaaggggagtcaacaattctgctaataatttcaatcagaagttatgggtgcgtcaaaggagctggggaatttgggaaagcaaggcagaacagcagtgaaatgagggtcaaggatgacatatatataccctaccttctttcttgtaccaagatcttggcttgttatgtcttatgtttgattgaggaaatgaattatagacgaggacatatcacttgtgttttaaaccacaactaaacattaaagataacataccaggccgggcgcggtggctcacacctgtaatcccagcactttgggaggccgaggtgggtggatcatgaggtcaggagatcgagaccatcctggctaacacgataaaaacccgtctctactaaaaatacaaagattagccaggcgtggtggcggacacctgtagtcccagctacatgggatgctgaggcaggagaatggcgtgaagccgggaagcagagcttgcagtgagccgagatggcgtcactgcactccagcctgggcgacagagcgagactctgtctcaaaaaaaaagataacatactgattcagatcaatgactcagaacagtttttggaagaacatgcttgtcctgcagacatttcaaaatgttaatcaccctttaatctcctttgtcactttttctaaaagaattattcactgtttgatttaatcctttaaaagtcatctatttacctcccatattgaatgtattcatttaattaattaattcttaacttactgaggtcttactatgtttcagccactacattaggcactaggaacacacagattaagtacaaaatgtattcctttgaggagtttactagttcaaggaggaaacaggtgagagaaccaaatattgttatatattatgataaggctattcataaaatgtaattgagaagaacactagttgtaatgagagcacagaggaaggtgacctatttgatactgagggtcaggaagatattccctgaagagaaaacagatgacctgaatctggacgatggtataggtgttagccagctgggccagtggagaatttatcaagaggaaagtacagcacaagaatgtgtataaaagcatggaaaaacttggcactcttagaaattccattaggcaatctggaggttgtttaaatgctgtattactcctaacaaaagtaacaggcccagtattaagtaaaataatcttatttatgaatgtacatgacatcaacatatcataaatttgctagtggggtctgctgggttaatgtgcacagcttcaataaagaacatatctaagtgattttaagaagttgtgtattttgactttatatcaccattttacattctctataattatagtctatacttactcagcaaaggaagcaaaactgctgaattaagttacattatgcattattaaagcaacttaatttgtggagaaatcatagaaaaacacagtaatttgaatgacttgtactagccagtattcctcctctgagaaaattctgccagaccatagctctgggtcaaatcctgagccaaaaaataataataataactccacatttctttttatttttaaattttataagagttttagatttaagaaaagttgcaaaaatagtacagcattctcatgtaccccacatccaatttcctttattgttgacattttacattcctctggtacatttgtcacaactaataaaccaatattgatacattattaaccaaaatgcatactttattaatattcccttaatttttacttaaagttctttttctgttgcaggagtccatccaggatactacattacatttagatgttatgtctccttaggcccctttattccgggacaatttctcagactttctttgttgatgatcttgacagttttgaggtagtcaggtatttgtagaatattcttcaacttgggtttgtctgatgtttttctcatggttagactgcattatggtttttgagaggaatacaacagagaggtaaagtggccttctcatcacttcatctcaaaggtacatactatcaatgtgacttattactgttagtgttaatcttgataacctagccgagatagtgtttatcagatttctccactacaaagttattttccccctttccatatgtaatttttggaaggaagtcactattcagctcacactagagaagtaggaagttctgctccatatccttgagggcagagttcataaattatttggaattcttcttcatgggagattcatctattctaccccatttattaatgtattcaattttctggcactacaagaatatatatatatttttgtaatcgactttaaaataattaggaaaatgatagaacattttaatataagagcaagatatggtaaattgatgaatattattagacattatcagtaacaagagctttgtatcttaagttgttttgagttcaatttcttgttcacatcttttagcttggttgagctaaaaaatcattaaccattgatttttttttgtaaccttgcatataatatgtacaatgagagaatcaattaatttagaattacatactcctaatttaaaaaagaaactggtgtacttattgctgataactaggaattatattatcaaagggctgttaattcaacaaatttacatgctaaaagagaaatttatatgttaaaagaaattaaaaggaagcaagagacattcaatttgcttttgatatgcagatttaaaaatactaggtccattttaatagatgataaatctccagtatcacaaggattagggaaagcaaaagacctgaaaagtaataccagttctcagttctctaactctcaaaaggcattccacaggtaaattcggtgaaagggccggcaattgttcaaatgtttaaataagaagaagttgtagttctcacatttccagttctcttacaggtgtgtgtatttggaaagataatactctctaatgttggtcttttccattgttcaggtttatcctgttgttaagtaataagcagcaatccaaatacaaacatattgtacaacagctattaatgaacatcacctgagttcagtgtgcctgacagctgacacttagttaatttctccatgaaacaagaacagtgaaacttccacagatgagaaaacagaatcatcagtggcactgggatgtaaacccaagtacctgctttgcatttcatttgctctgtttttcagaactacactttacgacatgagaaaaactggtataagcagaatgttcctacctttagttaatatcagttctaatttaatacataaatgacttgttcaaatacttacttagactccatgtaagggaggagaaaaggggagaaaattagagtgggggaagatgaatcaaatcacatttgtagaccacactacaacaattggaagctacttatcatatttcctaagataaagttttgttggatcctaatatgggaaggatttaaaagagatttaaaaaggtaggacagctaatttaaaatcccaaaattctcaaccaagttgatctcattggcagatggtagatgatctgaatgactgtgagcctagaaagttgaaagtaatttctttattgagaaaataaagacatggttcctaaggaaaagggctaaaaatgaccatgtttcaagtacactagtgaatagcaagtgaaacaaaatgtcttaagcatctatatgtcttatcttagatacatacaactattgtaggaacattatttctcttatctctcaggaaacatatttagttataatatgaaaaaaaactaaaattgagcttctaatagaaaatcaaaccctatcagaagaagagttacgtggagtaagcgattttataccgatgctgacttactctccctaccataaaatttgataaacaacaaacatttattaagcacctaccacatgtcaagaactctgctaaagacatacaaagatgactaaaagagtacctgagctcccagtctagggattaccacaaggaagagtgacggatcatgagtggaagggagatgagttaatacaaatggaaaacaggtttcattgtaggaaaaaggaaagtgaattaatgctttcgaaagagacattaaagtagatttctgggcaatatgaaactgagagtcaatctcgtcagattctgaaggcatctgtagataagcttcccaatgaaaaacagggcagtgacaataggacaactagaagtaagctataattatagcaaagaaggcaagagctagcataaacttgcctattgtcattgttgaagtcatagaactactcctttcaactactcttgtcatcagaggcttcctgatgcgatcatctgtggtgaggatagcttttcgagccccatcccactttccagggccctgtacacgatagtggattggagtgcagggtcccagtaataagtgtaatgccagcttggggtcagtgaaggccagagacagcagattgggcctgacccccaccaaatcagcaagctcttccatggtatctatgtagtctccctgaatggtatggcgttggctctccacatacctaaagtagaaaagacagaaaccatggcctgtcaataattcaatcagtcagtcaatcaattactgccttctgagtgcctgctattggctcaatatcagactaggagctgtggaatatagagaagaaagataaaacattggtcactgtccttaaggatcttaggacttacaaaaggagataagacagataaacatgaagcgagacttctgagtggtttcagactgccaaatagaaatgtggagaggggatagttaaaagagagctgtaatcgttaggttcttgaaggatgtgaaagatacagataagatgaggggcaggtatagcacatctagatacaaaggactctgatgttatgagaaagagaaaacccatcacaaaaattctcaagtatggcatcctctattatttgatgagggcagtggtgacagggtccacagggcaggacttcccagcgccaatgttaatttggaatcctgaaaggatgagggagaatgatttattccacaagaggaagtagccctccaaatggagacaaatgaaattattacaccaagtgcagatttaaagatttaaaagggctttttaaaggggaaaatgtggttgattaacagtgatatctgtgtggtggagtgggatttggtgagctaatgagtgactttcactttttactttctgtaatgaaaagaaagaactgtaggacagagaggaagagaaaagccaagtcaagccaattgagattgaagaatccaagaacagggacaggaaaaaaatgatagaaaataaatttgaggtagaactggtgagatggaatttcagaggacctgatagagggtcaagtaggaatttattgaaatgggactagatttaggagagaaaaaggtaaaacagtaaagaatttgagagctttcccttatgaacaatatgttggctcaagagtttgtagacatgcatttatttatcctataatagtaggtcaagatctatactattcatgaggttgggcgtggtgtttcatgcctgtaatcctagcactttgggaggccgaggcaggcggatcactttgagctcaggagttcgagatcagcctgggcaacatggcgaaaccccatctctacagaaaacacaaaaattagctgggcattgttagtatgcctgtagtcccagctactcaggaggctgaggcgggagaattgcttgactccaggaagtggaggttgcagtgagccaagatcacaccacttcactccagcctgggtaacagagtgagaccccatatcaaaaaaaaaaaaaaaaaaaaaaagagctatagtattcatgaaggtttcacaaaagaggttcactagctcctgccttgattatgcagattaaataaactcatataaaacaatgtatacacatagtcggcctttaataaaggttacatgtatacatatgtaaaaaacctgcacgttgtacacatgtaccctagaacttaaatataaaataaataaataaataaatatttactatttcagaagttaaaaaaaaaaaaggttacattatatccttgggttactgactactcaggttcaggaggtggttagacaaaaataagtcaaaggaaagagaggaggaaagttaaaataagatactttagagccagaaaagaaagcactgcaagaaggaagaaatgtttaaaagcaccaaactcagtagtgagaagaaggaaaatgaagttggtcacaggtgacctttaagagagcagtttccggccaggtacggtggctcatgcctgtaatcccagcactttgggaggctgaggcgggcagatcacaaggtcaggagtttgagaccagcctggccaacatggagaaatcccatctctactaaaaatacaaaaatgagctgggtttggtggtgtgcacctgtagtcctagctactcaggaggctgaggcaggagaatcgcttgaacccaggaggcagaggttgcagtgagcgaagatcgtgccactgactccagcctgagtgacagagtgagactccgtctaaaaaaaaaaaaggcagtttaaggagtaaggatggaagttaacaatgcagaaggcttagggaggcagcaaaaggtgagaatttagaaaatttagtgcagaggtttggcagtgaaaggaaggaggaaaataggagagcacctggaagttgtaacggaattaaataaaaacttactttctcctcctcccacacaaaggaaagttatgcaagtatcatcagttgaagataaccacctctttaggcctggaatgattgtgtctctcagttttccacagaaatttagagacttaccatcaatttccactttgtccaaataaaaaacacccagcgattgagcttaagttctgaaattcagactgctaaatgattgtgttcatcaaaacactaagcagctggctgttaccatgttcccaactcacagtgactattcataccatgagccactgtgacttgagtgtgctgtcacatgagcattgccagcaaagcggccactgcagacttgtaaatctacctacagatttgtaattcacccatagctacctctcattcatttactgtcactcttccttcctctggcaagtctactagcacttcaagtaatcctcacaaaaataatataccttctgccttctgattttatttccatatgcattttcctatgtgactttttttaggcattaaacatatgattttagacacctaaaacttttctctcttttcttacccatatttagactactagtgctatttctccattctattgtcacaaattatttttccttttttcttcataatagaatctaaatccttaagctaacatgaggcagttaaatacagtacaatatttcttttattaagaaataagtagaaatgtaaccatatatcttcctgggagagtttcttaccttttgtcaatttcctcttgagctttagatatttctgccatcatttcactctgtgagggcaatgtctttagacctaaaaacaaaaattaacattttaactgtaaaattacctcagaaggaacaataatcctataaacaattactatgctatggagaattcaaagaaatacagggtaagtttcctgtactcaaggaggttacaattcacttgatcaccttaccaccaccacaatataatattaacatctgcagcttactctacctattcttctttgtctttggaagggatttcccctactctgacttccaaccaatacctgcctcctccctaatgtagtctttcagttgggaaatgaaatatggacatgagaaaatggacttaaaggtatatggaaaattagttacaaagttaaagggcaggggagtgggaaaacacagctgcacctgtattcttgataacaaagggaccttatatcaacagaaagagaatgaagtaaaaataaattttttgtttttattattataccttaagttttagggtacatgtgcacaatgtgcaggtttgttacatacgtatacatgtgccatgctggtgtgcagcacccattaactcgtcatttagcattaggtatatctcgtaatgctatccctccccactacccccaccccacaacagtccctggagtgtgatgttccccttcctgtgtccatctgttctgattgttcaattcccacctatgagtgagaacatgcggtgtttggttttttctccttgtgatagtttgctgagaatgatggtttccagtttaatccatgtccctacaaaggacatgaactcttcattttttatggctgcataatattccatggtgtatatgtgccacattttcttaatccagtctatcgttgttggacatttggcttggttccaagactttgctattgtgaatagtgccgcaataaacatacgtgtgcatgtgtctttatagcagcatgatttataatcctttgggtatatacccagtaatgggatggttgggtcaaatggtacttccagttctagattcctgaggaatcgccacagtgacttccacaatggttgaactagtttacagtcccaccaacagtgtaaaagtgttcctatttctccacatcctctccagcacctgttgtttcctgactttttaatgatcgccattctaactggtgtgagatggtatcccattgtggttttgatttgcatttctctgatggccagcgatgatgagaattttttcatgtattttttggctgcataaatgtcttcttttgagaagtgtctgttcatatcctttgcccactttttgatggggttgtttgtttttttcttataaacttgtttgagttcattgtagattctggatattagccctttgtcagatgagtaggttgtgaaaattttttcccattttcttggttgcctgttcactctgatggtagtttctttagtccatcttgaattgatttttgtataaggtgtaaggaagggatccagtttcagctttctacatatggctagccagttttcccagcaccatttattaaatagggaatcctttccccatttcttgtttttgtcaggtttgtcaaagatcagatggttgtagacatgcggcattatttctgagggctctgtcctgttccattgatctatatctcccttttggtaccagtaccatgctgttttggttactgtagccttgtagtatagtttgaagtcaggtagcgtgatgcctccagctttgttcttttggcttaggattgacttggtgatgcgggctcttttttggttccatatgaactttaaaatagttttttccaattctgtgaagaaagtcattggtcacttgatgcggatggcatttaatctgtaaattaccttgggcagtatggccattttcacgatattgattcttcctacccatgagcatggaatgttcttccatttctttgtatcctcttttatttcattgagcagtggtttgtatttctccttgaagaggtccttcacatcccttgtaagttggattcctaggtattttattctctttgaagcaattgtgaatgggagttcactcatgatttggctctctgtttgtctgttgttggtgtataagactgcttgtgatttttgtacattgattttgtatcctgagactttgctgaagttgctcatcagcttaaggagattttgggctgagacaatggggttttctagatatacaatcatgttgtctgcaaacagggacaatttgacttcctcttttcctaatcgaataccctttatttccttctcctgcctaattgccctggccagaatatccaacactctgttgaataggagtggtgagagagggcatccctatcttgtgccagttttcaaagggaatgcttccagtttttgcccattcagtatgatattggctgtgggtttgtcataggtagctcttattattttcagatacatcccatcgatacctaatttattgagagtttttagcatgaagtgttgttgaattctgtcaaaggccttttctgcatctattgagataatcatgtggtttttgtcattggttctgtttatatgctggattacatttattgatttgtgtatgttgaaccagccttgcatcccagggatgaagcccacttgatcatggcagataagctttttgatgagctgctggattcagtttgccagtattttattgaggatttttgcatcaatgttcatcaaggatattggtctaaaattcttttttgttgtgtctctgccaggctttggtatcaggatgatgctggcctcataaaatgagttagggaagattccttctttttctattgattggaatagtttcagaaggaatggtaccagctcctctttgtacctctggtagaattcggctgtgaatccatctggtcctggactctttttggttggtaagctattgattattgccacaatttcagagcctgttattggtctattcagagattcagcttcttcctggtttagtcttgggagggtgtatgtgttgaggaatttatccgtttcttctagattttctagtttatttgtgtagaggtgtttatagtattctctgatggtagtttgtatttctgtgggatcggtggtgatatcccctttatcatttttactgcatctatttgattcttctcttttcttctttattagtcttgctagcagtttatcaattttgttgatcctttcaaaaaaccagctcctggattcattaattttttgaagggttttttgtgacttaatttccttcagttctgctctgattttagttatttcttgccttcttctagcttttgaatgtgtttgctcttgcttttctagttcttttaattgtgatgttagggtgtcaattttggatctttcctgctttctcttgtgggcatttagtgctataaatttccctctacacactgctttaaatgtgttccagagattctggtatgttgtgtctttgttcccattggtttcaaagaacatctttatttctgctttcgtttcgttatgtacccagtagtcattcaggagcaggttgttcagtttccatgtagttgagtggttttgagtgagttttttagtcctgagttctagtttcattgcactgtggtctgagagacagtttgttataatttctgttcttttacatttgctgaggagtgctttacttccaactatgtgatcaattttgcaataggtgtggtgtggtgctgaaaaaaatgtatattccgttgatttggggtggagagttctgtagatgtctattaggtctgcttggtgcagagctgagttcaattcctgggtatccttgttaaccttctgtctcgttgatctgtctaatgttgacagtggggtgttaaagtctcccattattattgcgtgggagtctaagtctctttgtaggtcactaaggacttgctttatgaatctgggtgctcctgcattgggtgcatatatatttaggatagttaggtcttcttgttgaattgatccctttaccattatttaatggccttctttgtctctttagatctttgctggtttaaagtctgttttatcagagactaggattgcaacccctgcctttttttgttttcgatttgcttggtagatcttcctccatccctttattttgagcctatgtgtgtctctgcacatgagatgggtttcctgaatacagcacactgttgggtcttgactctttatccaatttgccagtctgtgtattttaattggagcatttagcccatttacatttaaagttaatattgttatgtgtgaatttggttctgtgattatgatgttagctggttattttgcttgttagttgatgcagtttcttcctagccttgacagtctttacattttggcatgtttttgcagtggctggtaccggttgttcctttccatgtttagtgcttccttcaggagctcttttagagcaggcctggtggtcacaaaatctctcagcatttgcttgtctgtaaagtattttatttctccttcacttatgaagcttagtttggctggatatgaaattctgggttgaaaattcttttctttaagaatgttgaatattggcccccactctctcctggcttgtagagttactgccgagagatctgctgttagtctgatgggcttccctttgtgggtaacccgacctttctctctggctgcccttaacattttttccttcatttcaactttggtgaatctgacaattatgtgtcttggagttgctcttcttgaggagtatctttgtggcgttctctgtatttcctgaatctgaatgttggcctgccttgctagattggggaagttctcctggataatatcctgcagagtgttttccaacttggttccattctccccgtcactttcaggttcaccaatccgacgtagatttggtcttttcacatagtcccatattccttggatgctttgttcgtttctttttattcttttttctctaaacttcccttctcacttcatttcattcctttcatcttccatcactgatatcctaccaaacccaaataatttttttttgtagttttagtagagacgaggtttcaccatattggtcaggctggtctcgaactcctgacctcagatgatccacccgtctctgcatcccaaggtgctgggattacaggcatgagccaccacgcccagccaaaataaatcttaatcacattttatgcctaaagtcctgtggaagataagcttcattttctaaacatgtttctttgataagagtaggggttaaggccaaggggaactcataatacctaatattaactgataaatttaagtaagatgcacaaacagttccagttgtaggaattatacaccaaggacagggctagactaaggcttaatagtatttaagccagtatgaacaatgctaagcttaaacaattagttgtatgcccctataactagggactatgccatgtagaagattttggccacatccagtcctaaggtgtcactccataaaattgtggaatatggaatttcagaatggcaatatattttacctgatacaagcattctttctacaagtactctaacctagtggttatctcattcctctttaaacatcactggtgatgggtatctataataattatatctgaggtgattatataattatttgactgctctggctgctggaacattattgtttttattgaccccaagatctgactctttgcatttgcaccactggaccaagctctgctttctggagccacagagtttaatgttaatacatgacagctcttgaaacatttggaaatgattgtcataactcctttaagtcttctcattatcaggctaaacagtacatgtttcccatataatggttttcacattctctgccatcttggttgcccttcactaagcatactctaataactatcctggtgtatccctcttaaaatatggaactcagaagttcatcactctcaaatagccttctgttgttttccatgtgtttttacattttagccatgggaattattatttatcgtcataaatcaattaggaaacactgaaatgcttcatttaagcttaatcataggtctcttcggatactcaaaataagcgttttgagagtcaatttccaaattacttctacacaaccacaagttttacttctattagctagaaacatgaaggaggaggtatatttcttgattgtgggagacacccaattcataaaagaaagaaaaaaacaacaaaaaaccctatctattaccctatctgtctatatatagatagataaagaggtatatacatcttagtctagagctcatggggtgaaaaaattttaaaaaatttaaaaattttaaaaagatgtatacatctttttacgtgtatactctgtggtacagttatgtcttaattcataaattttgtttttgcagtgtttccttatttagacacattagctttaccatatttcttatctccctccatgtctttgctccctgtcttagtttcccaattccaatgaatggcctcaacacctgaacagattcttttctgtctctcttctccaacatgctttctgtcaccaaattcttcagatttgcctgtgaaatttcatttaagtctggctcctccaattcctttagagtgtcattaccttggtttaaagctctcatgctgtcttacttagacttttaccacaggctcgtactgacctatttcccatttcactcctctctaacatatcttctaaactggagatctgatttgactcctcttccagttaaaatccttcagtggttctccaacttgtaccttaaatgcaaactcttgatattgcctgtgaatatttctagtttcattttccttcattcctataacactttaccagcattctgaactacttgcagttcccagaactctatttgttctgtcactttcatctaactttgcataaacagtagtgattatttcccctctatggtcaatatttccttgtccttttagtaaattcctatgtagttgtagggagaattgggtacttattgcccactgctctcatggcagctcttctgcattgctactggagcacttgtttaggatatagttaaatatctgctgaatgaacaaatcattaagcatctgtttacttgtctgtctttgatatggtttggctgtgtccccacccaaatcttatcttgaattttgggtcccacaatccccatgtgtcatgggaggggcctggtgggaggtgatttaatcatggggtggttactctcatactgctcatgctgttctcatgatactgagtgagttctcacgagatctgatggttttatacggggctttccctttcactcagcactcattctctctcctgccaccctgtgaagaagttccttctgccatgattgtaagtttcctgaggcctccccagccatgcagaactgtgagtgaattaaacctctttcctttagaaactactcagcctcaggcagttctttatagcagcatgagaatgggctaacacagtcttccttgcttggctctgcattccagaaagatagggattttctgtatggtcatatttgcttctccagcccctagcagagggcctggtacatactaaaaggtcagtatatgttatctgaagaatgttgaagaacagtgaggaactgaagttcagagatcttccaagggttccaagacaaggtgggaaggaagacagtctgaattagagttctgtggtggtaggccttcagtctgctgtcagcctaaagcaggttgtatctgtgtaatcctgacttgctcctgcatatttcagtgtatagctaatgttatgagagaaaagagatctggctcccattctgcaatttcagtccagttcaggcttttaacataactggaaattggctaaggtagcccataagctgagatcctcaaataagaagtttctacatcagaatttagaatttaatttacctcaaggctaaactgacatttcttagaatagatgtttattagatacctcttatgtgctaggcagtggtctaggcttgcaatacaaaggcaaataaacatgagtcctttacttaaggagctatcactatattacaaagggagggaagaaatatgcatagacttttcctatagaaataaaaagtaaaaggagggcatatcaagaagaaagcacagtggaagcaaaagcacagggtacaagggtacctgctgtgtttgctgcttagtgggtacgtcatccagtgcatctagagtattgtaggaagtatggtaaagactagtgaaagatgggcctgaggccgggtacagtgactcatgcctgtaatcccagcactttgggaggctgaggcaggcggatcacgaggtcaagagatggagaccatcctggctaacatggtgaaaccccgtctgtattaaaaacacaaaaaaactagccgggcatggtggcgggcgcctgtagtcccagctactggggaggctgaggcagtagaatggcctgaacccagaaggtggaacttgcagtgggccgagatagcgccactgcactccagcctgggcgacagagcgagactgcatctcaaaaaaaaaaaaaaagaaagaaagaaagaaagaaagatgggcctgaaattggaggttgtatccaatttgtggaggaactttaatgccagcctatgacataatgacttcttgtgatccagagatttggtgtaacttgatatagttttgaaggaaagaaagttgctgagtgaaaataaaacacttgcaagggctgcaaaagacgcaatcaaaacagaaactatgtttcatttcagtcaaggcaaggaagtaaattcagtgttctagaaaagagtagaatattttcttgacaagagaacaataattccagagaacagaagaagaaggaaaatggggcttggtagggaacagacaaggaaggaggcaggctttgttgggcagacatgaaaaaaatgggaaaaacaagctaatccaaagggtttaaaattggcatagtgaagggataattcagggaagagaaaggcaagaatgtgggaggcagacagattggccatggacagaataaaaaacccagagttcctgttggaagtctggtaaagttagagaattctgaagatttcttccttccaggtgttagaaaaaagctggaggaattagcactaggcttctgctagcataggaagctgggctttttgtacattttccctaagatcccataatctcataaccataatgcagactcttgcaaatactcattttctctatttcctctcaagaattcacttggtcttggaaaagagtcccagttgcttaaagtatactaagatgctgtggcctgttttaatgaactgttctccgcttatgtaattgacccaattaaaagatcactttaatatgactagaattaggccaacttaatgggctatttgcgtttgactacttgtatagttctctcaggtagtacataatctgctggataggactggaagtaatagaaatttggggaaatttagaaaggttgttgaactatcaactgtaataccattggttctttttttctctgcaactgtgaagattttcactagtgaaaacaaaaaaggtgtaattccaacaggaactctgagtagttttaattaaatgctagtaacaatagcaaattttgttataacaaccatagaatcagtgaatttcttctttagaaggacccttaaacatcatcttgtttctctctatcctgaggcttgaatctactccataccttccccctctcctgccccggcccagtgagcattcagtcatttggcatccttttccttttctgcttagaatttcagaggcagctggttccatcatgaaatggcattggctgataggaaaaaggttttggatttttttcttaatggtaagctgatgtgtaaccctcaagatttcactccttgattctggtttgaccctttgaagctatactgagtaaatctaatccttcttccatgtgccttcccttcagatatttgaaggaaattctcatatctctcctgaagtttatcttctccaggctaaatctctctccggctttttcaattgtacttcagatggcatgttttcaaatcccttaaaaaatttttctctctctccttattaaacgcactccagcttcacttttaaaatgtatcattaggtgtggtctggccagtttagagaacaacagttgtaatgttctagaacattatagttttttaatgatgctagatttaattatttctttggaagctatatcattctactgactcatatgaaacctattccccttttttttttcatatattcctagccaaaactgaaagaggggacataaaaggagaaaagtgagaatttgggggattgaatatcctacaatattgactagtctgcaaccaggtcttaattttcggccgaaataaagtcatactatttctatattttatttttatctataatgaaagaagataaaactattttacttcagaaacatatgccagttgcctaaaatctagatgagtaaattctaatttggagtacacattggaattactggggaatatttttctcaaagatgttatgactgccccaccccagactaactaaataagcatcagcaaggatggtgtcaaagcatgcatagcttggaaaaatttcccaggtatgatgtatgtccatggttataaattgctactttagattcactcaaaaatatatttttctgtactaactttgtgctaggcactgttgtaatcatacatgctatctctagctatttaaaaacaagtacctaaacagaggtaaacatatcaccaagtaattaagtagtctatttgcatggtcacttacctttaaatacctgagtggcccagcgtccttggagctctgaaatgggcataatggctcctaagggctgaatcaagcctatgattgcaagagttggcctttccaggttaggagggaagacctttttatacagggatatcttgtttttgaccactttgacggaatcttccagaaacggaaagtcaaagctatagcctgtggcaaagataacagcatcaatgtcatcctccctggagccatcctcaaatatggcagctgtctccgtgaattccttcacatttcctttcactttcaccaagccagaaatgatacgatttggcaggtcatcatttaaggttggatgctgactcagagctctgtgagtcgtgacaaagatcaagtggagaaatgagagaaagagaaatcagtaccacataagtaaaattttgctttggtggaggtaaacagaatgccaataatcttccccttggtctatgcatgaagtttggaaaaggtctaatttatactaggttggcacagatcaagatcagatctgaagttggaccctggatgcactgaaagggagagtgttggaggagtgaaggaagagtgttgtttgaggagtgcatatatgatttctcaagtaacaataatattctgtgtgtgatatgataaggccacaggtcaatagtttgtattctcataccaagaagtctgacagaactaagctgtcaacattctgttcagtctcatttccagtttcaaaggctcaagagctaggtttaggccactgttttccaaactgtatgataaattacatgtatgtagcaatttacagtttataagttgcttttacatgcattaacttgactctcacaaaactctatgaaggaagcagaataggtgtcattatccaggttttataaatgaggaaattgaggcctagaaaagttatgtgacttgtccaatgatacacagcctaggattttagaatttatctcaaagttgttttcagtgaattatcttggtatacttcgggcttgttattgtttcctagggacagcgtaggatacggatactggaaacattgggttggtgcaaaagtaattgcttatttttttgccattacttttaataataataaggctggtttctagtatcgtggagctttctaaaaagcagtcttttttttttttttttttttttttgagacagagtctcactcttttgccgaagctggagtgcagtcgcacgatcttggctcactgcaacctccacctcccaggttcaagtgattctgctgtctcagcctcccgagtagcttggactacaggcacctgccaccatgcctggctaatttttgtatttttagtagagacagggtttcaccatgttggccaagctggtctcgaactcctgacctcgtgatcctcccacttcagcctcccaaagtgctgggattacaggcgtgagccacagcacctggcctaaaaagtagtcttaatgcctgaatactatattaactcatcttcagacagagctgtcctggcctcaggaattttatatgtttaaattaccactactggtttgttgcatttagttatgctttgacactaggtcgattgtgttctgcattccaacctcatgatttcatctttttctccaaacctactccttttcaccagcagtaccaccatccatccatatagttgcccaacccacaaaaccatgagttatatatctggtcaccaagccttttccctttctcctcttaacatccccaagatagttttatctactccttgttatctcaaccagatgatacaattgtctttaggacctcctgtctcatcccactcccacaccattttcaaaatggtctttctaaaatgtaggtatgattatgttactcacttgcctaaatctttgaatggctttggactgtcttcattccatactttttatttagtagaccaaaggttttctttttttttttttgacagtaacaatatgtttattataacatccagccaagaatacaaacacaaaatacctcttaatgtaaggagaataagaaaacatcacgcgattcttagaatactactacaaatacagccttcacctacagtaaaaattaagccaatttcaatcattttggtcatcatcccagtctttcttcccacttggaggcttgggcccaccatctggttttgccatgattacctgacccactctaagtacagtgactgcagcattagcagcgagtttgatagaccagtgttttcccaggtaagtatctagaacaccagcttccaacatgtccgttacagcagggactacagcctcagtatctaatccaacatttttatttccttcttgaggtactgcataaagtttagagattacttcattggccttaactccagagttttctccagagtatttctgccagtgcacggggaatagcttcaaacgcctcagcaaacttcttaatagcgtactgttcaagtccaggacatgtctctccatatgatgtgatctgtttggctaattcaatttctgttgctccacctccgggtacaagacgtttatcccttgtaagaactttgaaagtattaacaccatcatctactgccctttctatgtcatccatcagattgtctgtagagccctgaagtactatggtagaaatgatgccatcttccttttcatgcttaaaaaccaccacctgagtatctccaacttctgagaggtaaacactgtctcagtgtcccatttcttcaaggacaggaggtgtcaatctaggaagagctgtagcaccaactgttttacagagtcttcagacatcccattttgagtttagcttcactaacatcatattatatttgtttgcataatgaagagccatgtctgccactttgccacctgttactacaacatttgcaccagtatcagcaatagctttgacttatgcatccatgagattttcttctcccttacttaaattcatcaattcttcatcagtctttatcaacactgttcccttagtttctgttatcatgccatcaaaaggacaagagtacactgctatttttgcatctttgacagatgtacatcaccttctgtttccttcttaaaaaccatgccatgcaatactgaagaggaagtgataccacagcccagaattttacaaactctgatgttatcaactttgaaatggccagaatcaggaaaaatagatacgcatgcctgaacaataagcttggccagaaatacttcattaccatattgtttacacattacagaggtacgaagtagagatgagacttcatcaacatctcgaaggttttttgcagaacaacgtaccaaattaggaagaatctcatgagcttttctgcaagctatttcataaccttctatgacctctgaaactgacaggccaatcctcagaagttcttcagctaattccaggagagctccagcaaataccagaacaatgtttgtgccatctccaacttcttgctcttgcatatgagaagccattacagtcatttttgcagcaggatgctgtacttctagttctcttaaaatagtcgctgcatcatttgtcacaaacaacttctccaagtagttgataaccatttttttcattccatttcgtccatatgctgtacgagtggtttgggcaagctccttgcaagcttgtatgtttctatacacagcctcttctaattctgaaaagtgtttcgctccctccttgagcatctgggcgaagcccggagccttgggaacttgaagcgccatggccagcctgcaggaagccgttcacgtgaccgctcagaagaccgcggaggaaccaaaggttttcatgcctgatgaacctggagatacattcagtcactcttccatctttgctatatagtccagccataccagactacatgcaagtcctggagcataatgtattttttgctgttccaagactttgtctttataattagaatgctatacccttgctctatttgtttggctatctcctattattcaacaaagcctcaatttattttgcaaccaccaaaaacatgcatgctaaaataattaggtgaaaggtttttaggaaacacagtctccaaatgtcaccccactgattaacttcaacgggaaaaaatatctttatagtggagaaacttgatggtatctataccaccttatctaagtggtcaaatttagcattattactgtgagataaactgacataatgtggttcttgatgtgacccactaagatcaacatgtcctatgtagtatatgtgtcaaaaacatttaacctgaatataataaaggaaaaaaattatgcaagtctaaatttagagactctctacaaaacaatgccttgggttcttaaaaagaaagcccatgtcaaagagagaattatttcttatatagaccaatggaacagaacagagccctcagaaataataccacatatctacaactatttgatctttgacaaacctgacaaaaacaagaaatggggaaaggattccctatttaacaaatggtgctgggaaaactggctagccgtatgtacaaagctgaaacttgatcccttccttacaccttatacaaaaattaattcaagatggattaaagacttaaatgttagacctaaaaccataaaaaccctagaagaaaacctaggcaataccattcaggacataggcatgggcaaggacttcatgtctaaaacaccaaaagccatggcaacaaaagccaaaattgacaaatgggatctaattaaactaaagagcttctgcacagcaaaagaaactaccatcaaagtgaacaggcaacctataaaatgggagaaaatttttgcaacctgctcatctgacaaagggctaatatccagaatctacaatgaactcaaacaaatttacaagaaaaaaacaaacaaccccatcaaaaagtgggcaaaggaaatgaagagacacttctcaaaagaagatgtttatgcagccaaaaacacatgaaaaaatgctcatcatcactggccaccagagaaatacaaatcaaaaccacaatgagataccatctcacaccagttagaatggggatcattaaaaagtcaggaaacaacaggtgctggagaggatgtggagaaataggaacacttttacactgttggtgggactgtaaactagttcaaccattgtggaagacagtgtggcgattcctcaaaaagaactagaaataccatttgacccaaccatcccattactgggtatatacccaaaggattataaatcatgatgctataaagacacatgcacacgtatgtttattgcggcactattcacaatagcaaggacttggaaccaacccaaatgtccaacaatgatagactggattaagaaaatgtggcacatatacaccatggaatactatgcagccataaaaaatgatgagttcatgtcctttgtagagacatggatgaagctagaaaccatcattctcagcaaactatcgcaaggacaaaaaaccaaacactgcatgttctcactcataggtgggaactgaacaatgagaacacttggacacaggaaggggaacatcacacaccagggcctgttgtggggtgggaagagtggggaagcatagcattaggagatatatctgatgtaaatgacgagttaatgggtgcagcacaccaacatggcacatatatacatatataacaaacctgcacgttgtgcacatgtaccctagaacttaaagtataataaaaatatatatatataaaaagagagattaaagagacatgacaactaaatgtaatggtgtgattgattacctgacaggatactagatttaaaaagatttttttaaagctataaaaaatactactggggcaactggggatattgccaatgtattaatgtattttatcaatgttaaatttcccacgtgtgataattatatgatggttatgtaggagaatgccctttttcttatacaatatacactgaagtatttaaagtgtcttaatgactgcaacgtactcaaatggtttcagaaaaaaatgtacttgtgtatgtatgctctatatgtatggacctatctacagagatggggaaaggaagcaaatatagcaaacttaacaggtgaatccaggtgaaggatatatgggtgctcattgtacttattattttgcaacttttctgtagatctgaacattttcaaaaataaaaagttggagggaaaataaatttaaaatcagcctctagaaatgttttccctccctggttctctgaggaccccatcctttgtactttcataacactgtatgtatttcttcattataatctgtcctctttcttctcattagagtatttaaggtaagatctattttttgagtctgccatttattatttctgttgccctcgggaaaattacttagtttctctacatctcagtttttatatttgtaaaatgtagatcaaaaattgtggaggccaaagcaactccatcttagaagttaatctaccatattgacttctgatcaaccctggtttcgggaatacctctgagatttccagttaatctgttgtttaatagtatgtacttactgtaaatcccacccttagggcaaactcctacccattcgctctgaagtatgtgtgcccctcccctgtggtatatcatccctgggtcaggagataatggtatggggatctaccatcttgtctcaccactgcctgagacagacatggcttctgttcataagtccctatgaaatgtttctaagaaactgaatctgtcagcttctttcttcagcctctcagcttcctcagcctttggggtaggtttgcatagacctcctcactgtgaaacaaaaatagtaccaacttatagggctattgtcaggattaagtgagatactgcatgtaactcatttagcactgtgcttatcttatagaaagtcctcagaaaggtgagtgttatttctattactattactattatgtcttctctctgtatttcatgcccatgtatgatgcctggctcataacaggtactcaatgagtaaatgacgcactgtcctcagctatcattttgttgttgggtatcatgcaaaaagaactgatacctgggggaatgagaaaagggttactgccaaagagaattctagattaaaaacccacagaccaatagatcttggacatctgtgggtacaagttagaaatctgatttcagattctatgagtctataggctttcttttctttttcttttctttttttttttttttctttttgagacagagtctgttgcccaggctggagtgcagtggtgcaatctcagctcactgcaacctctgcctccagggctcaggtgattctcctgcctcagcctcctgaatagctgggactacagacaggtgccaccacacctggctaattttgtgtttttagtagagatggggtttcaccgtgttggccaggatggtctcaaactcctgagctcaggtgatccacccgcctccgcctcccaaagtgctgggattacaggcgtgagccaccatgcccagccactgtgggttttcttaatgtatgggtagaggtggctttactattagccagtgtgaagagtccttattcttgtgctttggccactatccctgcactcccatcctgggaacatacctgtgtttaggcttcaggccaaacatttcatggtcaaacctttggtttatctttttttccaaatatttgtttgctaatgattggccacagatcttccatataaaatgtgtaagtcgagaagagaacaacacatcagcaggatatccgtagtcccctacacgattcaggatccaagcccctctcctggtgctgaggaaaacctggggcatggaagaaattgtttgcttttgtcactcagattcgtaaaccttcaaaagcacccccattttcttcaagaatcatttcaggcccggcgcggtggctcacgcctgtaatcccagcactttgggaggccaaggcgggcggatcacgaggtcaggagatcgagaccatcctggctaacacagtgaaaccccgtctctactgaaaaaccccgtctctactaaaaatacaaaaaattagccaggcgtggttgcaggtgcctgtagtcccagctactcgggaggctgaggcaggagaatggcgtcaacctgggaggcggagcttgcagtgagccaagatcgcaccactgcactccagcctgggcaacagagtgagactccgtctcaaaaaaaaaaaaaaaaaaaaaaagagttcaaactcattagtctggctttttagcccctgcacaatctttgtgggtttttatgtttgtttcctgccattttccttcccaaacactaaacttagaattaaattggtgtatctactgtccaagaatatgttttgctctaatacaccgttgtatttctgtttagtgctattatgcctgcctgaaatgccttctttcctcttaactctgcgaagcctgttcatttttaagacccagatcaagactgcctcctccatgaagaaaccgctgactattcaggctgacaattttctctccatcctctgaatttctctagcacttatcacctgtagaactcattaaaaatcatgtactggtaaagttgaaagcagctggagaccatttaatctaaaaccctcattcttttgccattgacattgttggcattattacaaaaacccctgctatttatcatttttattgatattaaactttctacactcctaatttctgtttcttcaaatgtgttttctcaaggataggagataaagcctacacatccacagcagattatcatcacttccatttattgggatttgtgacctttaagtcattgtgctaggtccttcatctatattacaacaacctcttgaggaaagtattattacacccatgttatagatgaggggcatggaaaggatgaataacttgcctgagatcacagagctagtaagtggcagaggtgaatttccaacccaggtctgactaactccaaagcctgtgcttaagaaatgtttgattgattatttaatggagaaaaataagattgctagtggaacaacaggaagctagtcagtctttctgtgtcctcctctggctaaagttcatgttcagaactgataaagatttgatatgcagttacctggcaaaagaatcacttttcctacattatgaaactctctggagatggcttccagattttaagttatatacgcacattgcttcatagtctttttgtctaaaatgacctgtctacagagggataattgtttacttcacaaatcttatctcgcctaaagtgactgtaagcactctgataattatgtacttccacagtcacagttgaaagagcatatatggtcttagaaactgaacaattttgtgtgctggctatataacttctgctgagtaatgaaaacgctcagagccctaatgaaaagatttcctatttatgaaatagtaataataataatacatatatcacaaggctgttgtgataattaagcagtgtttttgtaaaaggtgtggtatatagtaaacacttgataagtgcttaatggctgtcatatttcttatttcagttttccatctataccttgttttaagcaaataacatttacaaatcagatttataaggaaaattgtttaatcagtgtaatcttatatgaaattaatattgaaaaaaaggaatgttttctctttacaaaagcatctacaagaattatacgaaaaacttccatgatatactgaaatatataggtccatttaaagtttttgatttataaacaaatcatcatgaatacaatttacaagtaaagtaaaaagttagaactcagcaattgagtttcttcagcttggattagtggtgtgacagtattgcctctgctatgcagacatagttttcctttgcattttcccaggctttctcacagacacagccaccttatctgtacccacacagaaatgctttgttatgtggcaacctgcaattccccagagcaggtaaggccaagctcccttagaactgcccatttgacaagccaatgatattaaagatggctctcgccatgggtccccactccacattttgcacattcctctaccataacacccacatacgttttaacccttgtttatataattattttaattatttttaatccttgtttatatgattatttcctgataaatgtctgttgaattaatttatgaagtatcatatgaaataatttttgtggttatagatgaggatagcaatgagaagaagtgtttttcaaacaaagttgctgagtaagagtcatttaacagaattgtagcactaagcttctaattaaaataaaacaatttaaaacatctttatagagaagcatggcttaattaaagttactaaagaacaaccaagacatttacctattgccaatagagtttgattcaacacagacattaataacaaaatacaatattggcatgtctttttccaggaatttatagtgaagacacttgcttctcagttcaaagtctgctatacaaaaaccacaacaaacaaaacaaaaagccaaggagatataattgctttagaatgaatgttatctgagttacctaactgtatgcaaaggccagggcaagctgcttgcatgtgctacagtttggacgctatacggatacccacattgtctttgggaagataaaattgatacttttttccatttggggagtgtaaaggaaaattcaagcaccatcctatgagtgaaaagtttccaatgatcacgcgtgctttcctttatgtaagaacatagcacttctgctggccaattgaagatcctcgctctcaatactgctttctaacaacctctcccagcaattactttgtctttatcaaagccagaggcacactctgagaagatgcctgattaggataatgagcccagactttagctgatccagttccttggtgtgaggctagttgcacaatggaactctaactggtagccttaactcctctattagcaccaatcaccatgttgccaactgaggtaatgaaacgaagccctatatttgccactggcactgaagggctatgtgcaggtatccctattctctgttgggtccacctgcagcttccttggagaaactgaagctagagttaagcaacgtaaataataattgagtgattcaaacctgcttggctgtttggctaatctctacagccagatcccctccagaattcccaatgccaattataatgactctctttccagtgaatccctctgggttcttatagtctcgactgtggaagtactgccctttgaacttctcaattcctgcaagagaagggaaaataattattgggtaatggtttacatgatagatatcatttgtcaagtcatttgttttttttgcagacttaagtttaagcatatattctccaagtgttctctttactcagctactttcttgcctttctcagtatttttgcctattttcttttcccatagcctcagagtagtaccttgtgatttccttgtcatatgtactttgcttaactcaggatgtgtttgtattttggatttagagatataaatataaactgcctcagaaaacctccattctcttttatcttttcatccccttaaatacctactcgcatttcacttacagcacatatattcttatatactttagagtatagagtgcttttttttttaaatgaaaatccaggccaaagactgaaattcttcaagctttcattccttccttagaaactcaatatttgtgtttactgctgaaaaattccttattctacctaatgctcctcaagaactccacattcttccctttgatactccagtcatttgatacaatgactaaagtcattgtaaaactaaatagactgcaaattttgctctaatctccaaaattacaaaaatggcagtaatacaagttaccccaacatccttctggggaacaagaataattaggataagtcttacttcattccaaagtaggaattactcagaccacaatcctcccattcctcaggggtcaggtcacaggcatgggtcaagggtcttccttcctggtaagctgctcaccagggaagctttccagaggtagatgagcattggtgtgatggccagtgcaaaccatgactccatcaaagacattcatctcctttttcccttcagattcagtgaccacttcccattggcctgaagtggcaaaatcaggctgcttcttcacactgcacacagtggtctgaaaagaaaagtgataaccacaggggacatccctgacatgactctccttgcatagtgttacacaaagggctgatatcacaggcactatcacataataggacccatgcagggatatttgattttcatactccacaaataagaactgtttggggctgtagtcagaatgagaaaatttccacaagacagaaaaaaataacatagtgttggcaggctaatgtaccctcctcttctagaaaagtgcaagtcactaggtctcttggtccaggtcctaaggcactgtaacacctgagtaaagcctgggcttctcctgtgcttttatgacactccatgcactaaatgcctattcttctcctgacccctatatgtcctgagaccttctgatgtcttcttaccctaggttctcttctcctggctacctttaaataagtgactgagctatagggctccttttcctggtagggtagaaaaacacctcagtggctctcattttatataaatgaatctccctttggctcccataaatacccattttacaaagaactataaagaaagaggctgtgaaacaggatagtgttatgatttttagctttataaaaaataataaatatgggttaccctacttaggttaaggaaacactatgtgcttctacgggcccatgaccataatgtcttcatggactaatagagacaccatcccggccgggtgcggtggctcacgcatgtaatcccagcactttgggaggctgagccaggtgaatcacccgaggtcaggagttcaaaactcacctggccaacatggcgaaaccccgtctctactacaaatacaaaaattagtgggtgtggtggcacatgcttgtaatcccagctactcgggaggctgaggcgggagaattgcttgaacttgggaggtggaggttgcagtgagccgagatcgtgtcactgtactccagcctgggcaacagagcaagactctgtctgaaaaaaaacaaaaaaacaaaaaaaaaaaaagagagacaaaccacccctgcatgcactagcaatccagcactatttatagttcctctatcatgttcttttacacaggctggtgcctctgccgagatcacccttttattccttatttggtagactcctactcatccttcaagactcagctttaagaaaactttatcttctttaagaaaacttccctggaacctgatatttcatgtcctgatgggttcaacatctttcctccgagctgcaacgtatagatctctagcatttgtccccatgtaactctctatttttattaattatatttataataaaatttttcttcatttttatccccttaactagactataaagttactgatttttcttttttgtctttgcatattcaatgcttagtatggtagcaaacttgttcaataagtattgtttaaataaatgaagagaagcaccactggaatgtaaatgacttactttagaagttcactagatgttttcattttcttattgtcattaagcagaaaaaggcatgacttagcaggatgatcagaaggcagaaggtttgggctttttgccagctgtcagaaatatctgaccataaaattcttttatggtcgtgatcagaaattatagaaaagtcctagaatactttagagcaggaaggaaccacagaagtgatctggtacaatcatcttgttttacaaacaagaaaatttttaaaaattgaaattgaggaaattgcttgtctaacatctaagttagttagtggtagggcaagcaccagaattcaggtttttattctgcaattccatgttctcccctctacaccagagttaactacccaagagctatactttactgggtttttatgatgttcatgtaaacaaatatattggaaagtacttcagaaagtacaaaagggctaagcagtaatggacaagttgtggaaccagagagttttaaagttcccatacctatcagttcccttctgtaatggggaaaacatttcccttcatctgtttattgcaatcaaataatgtgaaatgaaggtaatgaaaacactctgccaggtggcttcctgtatctgcagccaaaatatatgaaagagagactgtcccttgaatatttttgaggagcaaaggaggacaaagaatggagtttttgcctgggtaggataaatacatgtgcaaatcaagccaatctttagaagtaaacataggtaactgaaaccacgttattcatttacttggcaaacaacttcaaacacaaagatacccacacaattttctaccttaaatcgaatatactttagaaggtcaaattctttggcatacatcctgaaatactccaggacctgggcattatgcatgaagttgggataatgatctgggattggatagtcactgaagcacatcatctctttagaagtattgatgatcactgatttgtaaatactggcccttccttcttcaggattttcctgcaataaatagaaagtattcatagcaacttgaggatcatcttcatgttttataatagccaatagacatctgaaaaagttttctgaaagaagtgtcaattaaatcacacacacaccttccagtatttgtgcccttatgtagtcccttccccttgaatctcagttatctttatgacttgcttttgaccaacagcatacagttgaaatgacactgaatggcttccaagaccaagtcataagtagccttgcggattctgcctgggtctcagaaagctcactctggtagaagctagcagccatatgagaaatccaactaccatgagatcaccatagcttgaggaagtccagcctcaccacatgaagagaatgtctgggacagaaaatatatggccagtccccagaaattctacctattctattctatcccagctgaagttctaaacatgtgaacagaaagttactaacactgagtaatagtcttttaaatgagtaacaatgaggcaaaatgggaagatacacaggaaagagtgtaacagtttccatatactggaaagagtataacatctccagcgttttctggagagcagtgttaaaatgtatatgaaactccttgcaatttacctagccttttaaaaaaatattcagcatcgcttaggaagatttatgttaaaggatgttaataccagcattattcataatacaaaaatgagacaagctaaatgcccaaaaaaacaactgaaatttgagaaccactgctctagatccttactaccaaagtatggtctgtagactagcagctggggcttcccttgagagattgtgttagaaatgcagactctcaggccccacctcagacctactgaatcagaacctgcatcttagcaaaatcttcatgtgattcagaattcagatgctcatgcaaactgagatgcactgcattaaatgacattaatcctcaattcagtgttctttcccctacaacaaacttctttgcatcctcaaaaacttcctattgaggccgggcgtggtggctcatgcctgtaatcccagcactttgggaggctgaggtgggtagatcatctgaggtcgggagttcaagaccagcctgaccaacatggagaaaccctgtctctactaaaaatacaaaattagccgggcgtggtggcgcatgcctgtaatcccagctagtcggggggctgaggcaggagaatcgcttgaacccgggaggcggaggttgcggtgacagagatagcgccattgcactccagcctgggcaacaagagcaaaactccgtctcaaaaaaaaaaaaaaagaaaaagaaaaaaaaacttcctattaactatcttatagcattgttgtggtgatcacataaagtaatgcaatgatgcaatctacccagcctgtcaccgagatttcacaaatgaggagttttcaaatttttagattttcaaaaattgttttgactatggaaaatcaccttaatcaatttggatctcctcctccctttttattctagaaatgaacagatattgagatattgagtattatgaaacattaaatagccacaaaggagagtgtttgttgtttgttggctttgtccacctttaggattgtttttctcccatttttattgcttaattattcaatctaggaatcctaaattgatcattcccatttctctgacctataatccaacatctcatttctttaactgctaataacattttcataagactcctttgaagtctcttcttctaatctagcctacctgtttcaaccaaagtgttctctctaaggtgtggctggactaaatctctgccctaattaaaattttagatgttttcccatttcctgcagaataaagttcctatttctcagcttaggattcaaagacctccataatgttttgtagtgtattccttatctctccaactagattgtaagccccttgaattgtactcatggttttccccacagcatccacaatgataaatagcactcaataaatgtttaatggatgcatatcaaattgtattgagaaagggatatacagaataagatgtaagtttcacaaaatgcataagaaaactaataaaatacatcaacatttatctcaaaaagacttcaataagatatatgtatctcccaaaattttgtcccaagaaaaatttcaaaataatataaagtcaaatgcatagatatatttttgtataacttaaatagcaattaattagtaacaatgttaaatgttcccaaaatagatgaatggtttagtaaattatagtatctcaacatgcagaattttttttttttgagatggagtctcactctgtcgccaggctggagtgcagtagcacgatctcagctccctgcaacctctgcctcctgggttcaagcaattttcctgcctcagcctcccaagtagctgggcctacaggcacgcgccactatgcctggctaattttttttgtgcttttagtagagacggggtttcaccatgttagccaggctggactcgatctcctgacctcgtgatccgcccgcctcagcctcccaaagtgctgggattacaggcgtgagccaccgcgctcagcctcaacatgcagaattcaccttccacaccactccatgggtatcctgataaatacaaagtagatcctgccactccactgcttaatagtttctcttgattccatatggaaaacaaaattccttattttgaaatttagcacatttcacaatctagcccggtttatcttttaatcttcatccagtgttgtccttatttaatctcaaatttctaagtcattaaattgttcctgaaacactctaggctcttgcacaactttaaaccttcgtaaatattactatttcttcatctggaaaatttcctgtccttcaagagttacatcaaatgtcacttccttcaacaagacttttctaatttctccatagaattagattcccctattcatcctccaagctcccaaaactctctgttcatatttctataaagataacttaaacacactatattatcaggcatttgattccatgactgtgagaaacccgagagtagccatatccttctttaaatctctattatcaggacctggtgtgtattggatgtgcaataaatgctttgaaatgaattagttaatgaattatggaaattgaatttggagacaccaaaaactatgattttgaagtctgtgcaggaacattaaaaatggcgtatgatataatgaagtacaaagggaactgtaaaattaaatttacattctaatcaccaaatatgtaatattatgtctatctatgggtatataattatacttgtataatcgctccctgttagacatgtctcttttgagtatacttcatttatttgaaatagaaaaaaatgtgaaaatacagaaaaccagtcgacttattaaggcagtaggattgctttctttttctttttttttttgttaaaatgttgtttgtacaacacccattcatggtgaaaactctcagcaaactaggaatggagagaaacttcctcaatttgataaagaacatctacaaaatacctataaccaacatcatacttaacagtgagaaattagacacttttcccctaagactgggaacaaggtaaggatgtcctctctcaccactcctatggaacattgcactagaagtcttagctagtacaataatagaagaaagaaaagtaaaggatattcggattgggaaggaataaagataactttttatttgcagatgacctgaccgtctatgtagaaaatcccaaaggattaaaaaaaaaaagtaagaaaaaaagaaaaaaactcctagagtcaacaagtgagtacagcagggttgcaggatacatggttaacatacaaaagttaattgctttttttttttttttttttttgagacagagtctcgctctattgcccaggctagagtgcagtggcacaatctcggctcaccacaacccctgcctcccgggtgcaagcaattctcctgcctcagcctccggagtaactgggactacaggcgcatgccaccatgcccagctaattttttgtatttttagtagagatggggtttcactatgttggccaggctggtctcgatctcctgacctcgtgatccacccacctcggcctcccaaagtgctgggattacaggcatgagccattgcacccagtcatttgcttttttatatactagaatgaacaactggaatttgaaattttaaaaactccatctatagtaatacccctgaaattacatacgtaggtataaacataacaaaatatgtataggatttataagcatgaattagaaaacacagatgaagaaagtctaagatttaaataaatggagagatattctgattcatagactagaagattaaatattgttaagatgtcagttctttccaacttgacctatagatacaatgcaatctcaatcaacatcccagcaagctattttagaatccaagctaacacatggattctaaagttcatatggaaagacagaaggcctagaatagaagactttgtccttaatagtgggctgtgcatagtgactttgttccaaagagtatagtatggcaatggagaaaaaaggagcaactttacagtgtggcaaaaactgacaaatgctatttcaagccaggacatcaaggttaacatcaatagtgatattatctagggtttttatagttttagattttacatttaactttttaacgcatgttgagttgattttcatatatggcaaaaggaagggatccagtgtcaatcttctgcatatggctagcagttataccagccccatacaatttatccttgtaacaaactttcatatgtacccccgaacctaaaataaaagttggaaaatgaaaaatagaaaagtggaacaaacttacacttcaacaaagatatattgtggcatatattgaatgctaatttcttacttataataacataaaatgagttttaagtttccaaaaaaaaaaaaaaaaacagtgggtataatgtggatagtatgtacccttgatgggaggtgaggagaatggcaccttataatattcctccccaaaagtcataaccccaatttaaccatgagaaaaaaataagataaatcccaactgagggatattctacagcatacctggccagtaagtaatcctcaaaactatcaagggcatcaaaaacaaggaaagtctaagaaatttcatagccaaaaagagcctaaggagatatgactattaaatgtaatgcagtatcctggatgggatcctggaacagcaaaaggccattaggaaaaactgagtaaatctgaataaagtatggacttcagttaataataatgtatcaatattggttcattcattatttaaaaacgtatcatactaatgtaaaatggggtaactggacatgaggtgtactgtaattctctgtattatcttcctaataaattttgtaagtctaaaactgttctaaaattaaaagcttatttaaacatgtttgtacataagtgtatatattttttaattaaggtaaattaatgaatggcaaggtcattttggaattaagatgtttgctgtatggagagcaggtgaggcatgttcctaacttctgaatttcatttcatttattcattcaagagatatttagaaagtccctctgtaataaaatactttatgaggtaccgataaatgcaagtctgtatgtgtattccaaaagttcaacgtttacaaagagtagagccatcctatccacagcaggtctgttgggatcactgagtgaaatgaatgacagatctcacctctttgaggtactcctatatttcaactctttttcaaatcactaaccacaacaagtgttatcctgtgtcaacaacatccttcaagtccttcgaaacacctgattggaacttaggtaaggtttaccactgtgccaatccactgctttccaaaagagtgagcacagagcagtattgggttagtgagtagaagaaaaagaagcttctgctcctgcattttacaattttctaccattgatgaataaatcttctctctacaaactctatacactgattatatttcctacctaggcacaaggctcacacatttgagcaggaagtctgtgtaagaaaagagaggctaggcatggtggctcatgcctgtaatccccacaccttgggaggccgaggtgagcagatcacttgaggtgaggagttcgagaatagcctggccaacatggtgaaaccccatctttactaaaaatacaagaattagcaaggcgtagtagtgcgtgtataatttcagctacttgagaggctaaggcatgagaatcacttgaacccaggaggcagaggttgcagtgagctgagatcacgccactatactccagcctgggtaacagagtgagactctgcctaaaaagaaaagagagagagagcaggggatggaagttggggaaattggaactgatgggattggaagaagtaataaggacagaagaaaggagaaaaatttaaatgggaggaatgaggacagtttggggcttctgttcctgtcagattttcaaaatcccatggaatagaaactctctttgaactgttgtctgcacattggaatcatctggggagctttaaaaaatggagatagtagaatacatgcttggctctagaaatataacggtgaaccacacaggtgtggtctgttggaacagaagtcagagcgttatgatgaaacacagcttatttattttcaaggaagcagtttacaaagtgttaaaattttgccaagtggataatcagaagaaaaacctccacgttaagtctttagcagagaataagtttaaaccacattggagataaaaaccagaaacttgataatcagacaagatgatggatgccctcccaacctcctcccatcctcaattgatttcatgccttttcagtaactgccaaaactggctaagatgcttagtaaagacaccacatgtgtgagtcccatcctaggcctactgaataataaccaacatgtaacactatgttcctggcactgttgtaagtgattggcataattatccattcacttactcctgacaataactctataaagtggatactattattatccacttcttaaagatgaagaaacacaggtacagagaagcttaatgatgtgcccaaagtcacactgctagtaggtgacagaaataaggtttgagcctaagactgcattcttaacctccataccatattgtggctggattttaagagcagaattttctgctgtttactaaaaacaacaggcttttagcccatgtccaagactgatgatgatacacgtatgcaggtcagctaaggggatccactccagatctgaataaggatgattgtcacataaaattagtccccaaaacagagtcagggtgcaaaaggattgtatttcggttcaactaagaaatgctataaagccacttttatgtagctggccaacaatgtgttagtttttatgaaatatgaaacgtaaaacttatctagggcacctcaatactattaaatgttcagaaaactagcttaaaagcaaacccgttctcctctagccacccaagatgccaataggaaagaaggctaagggaaagaaggcggcccccgcccctgctatcagtgaagaagcaggaagccaaaaaagttgtgaatcctctgtttgagaaaaagcctaagaattttggcattggacaggacatacagccccaaagagacctcaccctctttgtcagatggcccccctatatcaggttgcagcagcaaagagctatccttttataagctgctgaaagcacttcctgccattaaccagttcacccaggcttcgcactgccaaacagctactgactgcttacgcgggcccacaagcacagaccagagacaaaacaagagaagaagcagagactgttgtcctggactgagaagaaagctgctagcaaaggggatacccccatcgagacaccacccgtctttccagcaggggttaacacaatcaccaccttggtggagaacaagaagactcagctggtggtgattgcacacgatgcggatcccatcgagctggttgtcttcctgcctgccctgtgtcccaaaatgggggtcccttactgcattatcaagggtgaggtaagattgggatgtctagtccacaggaagacctgcacgacgttgccttcacacaggttcactaggaagacaaaggaggtgtggctaagttggtggcagttttcagaaccaattacatggacagatatgatgagattcgctgccaatggggaggcaatgtcctgggtcctaaatctgtgggtttgaatcaccaaagtggaaaagggaaaggtgaaagaagttgccactaaactgggttaaatgtacactgctgaattttctgtaaataaaaagaataaaaattctccttcaaaaaatgtaaaaataaaagcaaacccagcaaatccaatgcatgtcagtttggagatcaataaaggtggctggtattctttggaatataataagtttaactatctttttttaatttttttccttgagacggagtcttgctctgtcacccaggctggagtgcagtggggcgatctcggctcactgcaagctctgcctcccaagttcaccccatcctcctgccttagcctcccgagtagctgggactacatgcacccgccaccacgcccggctaatttttttgcatttttagtagagacgaggtttcaccgtgttagccaggatggtctcgatcgcctgacctcgtgatccgcccgcctcggcctcccaaagtgctaggattacaggcgtgtgccaaccgcgcccggccacctgacactgttaagataaactgtcgtatgcacctagttgcagggagggtttcaagtattaagggactaggagatgtatgtacctggaacctccagagccctccgatgtcatcagtcctttcaaagcagacaggttccaagccttcttctacgcagcacttgatggaagagagcccgctcactcctcccccaatcacagcaattcttttcttagtcatggtctcccgagatcttcacctgttagtgtcgcctgtcctaaagaaaggatgacaaaagacaaaaagcacacatcggttaacatttttcaaggaagaccttggccgtggcattcgaataaattctgtacaagaggtgtcttgaggaggacagattcgacggtcctcttcaccagaggaaatctttctgctggcatgggggagccctgcgcctgcaagacccagagctgagagtgctctgctgcggtaccggatctcaccgcctttcctgaagcgctcaacagatccttcagctgcgatctggaggagactcaacaggcggctgttgtcaaattagtataaaccaacaacggacaaacagcgagagccaacggggaggggctgtagcactccacctcctttcagggaccactcccccgcccactcagcggcacccattctccctccctcgatgggaataaaacgtgggctgaagctgctttgggcgaaaaagttaatcctacaacttctctatatttcagctgctgttgccagcactctcaattactttctctgaaacccctagccccgtctgtgctcgcttctgcatccacttttaacttcctggtttttgccttaaagtgacaaacacttcctagtgaagggaaaactgtcaacaaccccaaagccagttctactccaaatgcttaaatgaacacctacctttcaggtgatctgttcaaacagattgtagcaggatgagccacagacaaaactcctcagacaccgaattaaaaaaggaagaggtttttattcggccgggagcgtcggcagactcgcgtcttaagagccgagctccccgaaaaagaaattcttggcctttttaaaggcttacaactttaaggggtccacgtgaaagggtcgtgatacatcaaacaagagtgggaaacgtgactgggggctacaatgcttttttcatacagtgtcaggaattcacagataacacaagtagtttaggtcaggggttgatgttattattattactttttttaactcctagggccgggtggtggtgccaaggttgtctggctatttatcttactttttttttttttttttccaactttttgctttttctctcctcctgtcttgtgaacgaggcaaggtggtgggaggagggcagcagtagtagtagtggtctccttccttaagatgatcctgcccccacttccgcccccggctcacctatacctctctcctcccctcctcacaatctggatctaagaatctacacttctggaagaaatttacttttaaatccccatgcactgagctgagtgctggagtatagtgaggaatgtattgtttcctactcagaggggcttacagattagtggaggagaccaaaacataaacaggtaattttaacgaaataaaagtatttttaatagtgctttcacacagttatattagtaaccaaaaatacaaaatatccacttctaaaatgtaacttttcaaatataaagtcatgtagaaccaccaatataacagatacaagatttcaggcactgggttagaacaagggcccatccagacaagggttctatttgacagatgtgaggggttgtaagaggcatggattgtggctcatgccttggatccttgctctccttctaccactccctgagtcaattttgctcttccaatctgcacctgctaatcttggactttttcatgagaggcaactgatattttgtttgtgccattgaattttttgttgtatttatagcaacttagcagactctaattaacattaatgtgttttggaactgtcgaacttttttttttttttgaaacagggtctcactctggcacttgggctggagtgcagtggtgcaatcatggctcactgcagcctctatctcctgggctcaatctaccctcccacctcagccttctgagtagggactacagctgtgtgccaccacacctggtaatttttgtattttttgtagaaatgaggtttcactatgttgctcaagctggtcttgaactcctgggctcaagtgatccacctgccttggcctcccaaagtgctgggattacaggcatgagccaacaaggccagcctgtaaaatattttaaagactaatatctttcacaaaagcattcaactataaatgtgaatttatactaaaatagtatcttttaaaaataaaattctgaagacagtgtttcaacacaaccattttatatgctagaagttaacttaaaatgaattacttgtaaattggataattttgaatgcgctagaagaaatgcctaaaggaaaacatgaatacttttataaactgagtattaatttcctcctactgaatcagttttacaaataatgcaagaattacttttaaaatgtagttaacaatgtaattttattttaatgtccccctacttcaattgtgtcttataattaattgcttttgaatatagcaaatatgttttgtgttgtattaaaattacttatacaatgttttaaaccttgactcaaatgttctctctcttgcctagctgacaatttgcaagtaagtcaatttcttcattgaaaaataacttgatacatccaaattaatatacagactcaactcagttactcatgctattactagacagcaatattatgagtgagaaataagaacaactaattccaagataacatatgaggcttttgaaggagtgtatgtgtatggatgcacatgcatgtggaactgggtttgcagagtttctgcaaaggtccaacccagaaagagctttcaaacaatacagtctcacctctactcagatgctaccctgttttctaattctttctattacgtttgcattttgcccatattcattcagcaaacagtctcttttggaggccccctttgttttgagatggagcctcactctgtcgcccaggctggagtgcaagtggtgcgatcttggctcactgcaagctccatggaggccacttttttttttttttatcatactttaagttttagggtacatgtgcacaacgtgcaggttagttacatatgcatacatgtgccatgttggtgtgcagcacccattaactcatcatttaatattaggtatatctcctaatgctatcccttccccagccccccaccccacaacaggccccagtgtgtcatgttccccttcctgtctccatgtgttctcattgttcaattcccacctatgactgagaacatgcggtgtttggttttttgtccttgcaatagtttgctgagaatgatggtttccagctttatccatgtccctacaaaggacatgaactcatcattttttatggctgcatagtattccatggtgtatatgtgccacattttcttaatccagtctatcgttgttggacatttggcttggtttcaagtctttgctactgtgaatactaccacaataaacttacatgtgtatatgtcttcatagcagcatgatttataatcctttgggtatatacccagtaatgggatggttgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatccccattctaactggtgtgagatggtatctcattgtggttttgatttgtatttctctggtggccagtgatgatgagcattttttcatgtgtttttggctgcataaacatcttcttttgagaagtgtctcttcatttcctttgcccactttttgatggggttgtttgtttttttcttgtaaatttgtttgagttcattgtagattctggatattagccctttgtcagatgagtagattgcaaaaattttctcccattcggtaggttgcctgttcactctgatggtagtttcttttgctgtgcagaagctccttagtgtaattagatcccatttgccaattttggcttttgttgccattgcttttggtgttttagacatgaagtccttgcccatgactatgtcctgaatggtattgcctaggttttcttctagggtttttatggttttaggtctaacatgtaagtctttaatccatcttgaattaattttttataaggtgtaaggaagggatccagtttcagctttctacatacagctagcccgttttcccagcaccatttattaaatagggaatcctttccctatttcttgtttttgtgaggtttgtcaaagatcagatggttgtagatatgcggcattatttctgagggctctgttctgttccattgatctatatctctgttttggtaccagtaccatgctgttttggttactgtagccttgtagtatagtttgaagtcaggtggcgtgatgcctccggctttgttcttttggcttaggattgacttggcgatgcgggctcttttttggttccatatgaactttaaagtagttttttccagttctgtgaagaaagtcattggttgcttgatggggatggcatttaatctataaattaccttgggcagtatggccattttcatgatattgattctttctacccatgagcatggaatgttcttccatttctttgtatcctcttttatttcattgagcagtggtttgtagttctccttgaggaggtacttcacatcccttgtaagttggattcctaggtattttattctctttgaagcaattgtgaatgggagttcactcatgatttggctctctgtttgtctgttattggtgtataagaatgcttgtgatttttgtgcattgattttgtatcctgagactttgctgaagttgctcatcagtttaaggagattttgggctgagacaatggggttttctagatatacaatcatgtcttctgccaacagggacaatttgacttcctcttttcctaattgaataccctttatttccttctcctgcctaattgccctggccagaacttccaacactctgttgaataggagtggtgagagagggcatccctgtcttgtgccaattttcaaagggaatgcttccagtttttgcccattcagtacgatattggctgttggtttgtcatagatagctcttattgttttgagatatgtcccatcaatacctaatttattgagagtttttagcatgaaggattgttgaattttgtcaaaggccttttctgcccctattgaggaatcatatggtttttgtgtttggttctgtttatatgctggattacgttgactgatttgtgtattttgaacaagccttgcatcccagggatgaagcccacttgatcatggtggataagctttttgatgtgctgctggatttggtttgccagtattttactgatgatttttgcatcaatgttcatcagggatattggtctaaaattcttttttgttgtgtctctgccaggctttggtttcaggatgatgctggcctcataaaatgagttagggaggagtccctgtttttctattgattggaatcatttcagaaggaagggtaccagctcctccttgtacctctggtagaattcggctgtgaatccatctggtcctggactttttttggttggtaagctattaagtattgcctcaatttcagagcctgttatcggtctattcagagattcaacttcttcccggtttagtcttgggagggtgtatgtgttgaggaatttatccatttcttctagattttctagtttatttgtgtagaggtgtttatagtattctctgatggtagtttgtatttctgtgggattggtggtgatatcccctttatcatttttattgcatctatttgattcttctcttttcttctttattagtcttgctagcagtctatcaattttgtttatcttttcaaaaaaaaagctcctggattcattgattttttgaagggttttttgtgtctctatttccttcagttctgctctgattttggttatttcttgccttctgctagcttttgaatgtgttcgctcttgcttctctagttcttttaattgtgacgttagggtgtcaattttagatctttcctgctttctcttgtgggcatttagtgctataaatttccctctacacactgctttcagtgtgtcccagagattctggtacactgtgtctttgttctcgttggtttcaaagaacctctttatctctaccttcatttcgttatgtacccagtagtcactcaggaacaggttgttcagtttccatgtagtggagcggttttgagtgagttccttaatcctgagttctagtttgattgcactgtggtctgagagacagtttgttataatttctgttcttttacatttgctgaggagtgctttgcttccaactatgtgatcaattttggaataggtgtggtgtggtgctgaaaagaatgtatattctgttgatttggggtggagagttctgtagatgtgtattaagtccacctggtgcagagctgagttcaattcctgtatatccttgttaattttgtgtcacgttgatctgtctaatgttgacagtggggtgttaaagtctcccattattattgtgtgggagctaagtctctttgtaggtctctaaggacttgctttatgaatctgggtgctcctgtatcagtgagactctgtgggtgtaggaccctcggagccaggcatgggatataatctcctggtgtgccgttcgctaagaccattggaaaagcgcagtattagggtgggaatgacccaattttccaggtgctgtctgtcgcccctttctttgactagcaaagggaattccctgacctcctgtgcttcccgggtgaggcgatgcctcgccctgcttcagttcatggtcagtgcactgcacccactgtcctgcacccactttctgacactccccagtgagatgaacccagtacctcagttggaaatgcaaaaatcacctgtcttctgcttcgctcatgctgggagctgtaaactagagctgttcctattcagccatcttggctccaccccccagaggccacttttaaatggcatctttgtaagatagaataggcttgaatcttgagggagagctgcaaaggaaaggtggctgacaagcattggactgtgacatgagtgagaaatatactttttgctgaattaaaatgtggagagctatttgttcagtagtaaaccttaataagtcaatcctgactagtccaagagtcatttctagcacagtgtctgttgggaaaaagctgagtgttgggaagaaagctgaggcagggcttgcatgtctgacataatgtcctctggaatgtgtgtagacttgctggatccttgcttctagccctccaagctcctagagcggttgtaatcccattatctcaagtagcagaacatgttccatataaatgctaaacctcaacctctccctctccctctccctctccccatggtctccctctccctctctttccatggtctccctctgatgccgagccgaagctggactgtactgctgccatctcggctcactgcaacctccctgcctgattctcctgcctcagcctgccgagtgcctgcgattgcaggcacgcgccgccacgcctgactggttttcgtatttttttggtggagatggggtttcgctgtgttggccgggctggtctccagctcctaaccgtgagtgatttgccagcctcggcctctggaggtgccgggattgcagatggtgtctggttcactcagtgctcaatggtgcccaggctggagtgcagtggcgtgatctcggctcgctacaacctccacctcccagccgcctgccttggcctcccaaagtgccgaaagtgcagcctctgcctggccgccaccccgtctgggaagtgaggagcatctctgcctggccacccatcgtctgggacatgaggagcccctctgcctggctgcccagtctggaaagtgaggagcgcctcttcccggccgccatcccatctaggaagtgaggagcgtctctgcccggccgcccatcgtctgagatgtggggagtgcctctgccccgccgccccgtctgggatgtgaggagcacctctgcccggctgcgaccccgtctgggaggtgaagaacgtctctgcccagccgccccgtctgagaagtgaggagaccctctgcctggcaactgccccatctgagaagtgaggagcccctccgcccggcagccgccccgtctgggaagtgaggagcgtctccgcccagcagccaccccatccaggagggaggtggggatcagcccctgccaggccagccgccccgtccgggagggaggtggggggtcagccccccgcccagccagccgccccgtccgggagggaggtgggggggtcagccccccgcccggccagccgccccgtccgggagggaggtggggggtcagcccccccgcccggccagccgccccgtccgggagggaggtgggggggtcagccccccgcccggccagccgccccatccgggaggtgaggggcgcctctgcccggccacccctactgggaagtgagaagcccctctgcccggccaccaccccgtctgggaggtgcacccaacatgctcattgagaacaggccatgatgacaatggcggttgtggaatagaaaggggggaaaggtggggaaaagattgagaaatcggatggttgccgtgtctgtgtagaaagaagtagacatgggagacttttcattttgttctgtactaagaaaaattcttctgccttgggatcctgttgatctgtgaccttacccccaaccctgtgctctctgaaacatgtgctgtgtccactcagggttaaatggattaagggcggtgcaagatgtgctttgttaaacagaagcttgaaggcagcatgctcgttaagagtcatcaccactccctaatctcaagtacccagggacacaaacactgcggaaggcggcagggccctctgcctaggaaaaccagagacctttgttcacttgtttatctgctgaccttccctctactattgtcctatgaccctgccaaatccccctctgcgagaaacacccaagaatgatcaataaaaaaaataaataaataaatgctaaaccgtcacagctgtagatcatgagcctgctcttttgacccccacattctcaccacctgattctctgttggattaccaataaacagcgtgggctcccagagctcggagccttcgcagcctccacaattgtgatggccccctgctcccactttacttctcaaactgtggttttctcaatcctttgactctaccggactttgtcacccccaggatctggtgttgggtctgatcaccccaacagcatccattctatgcctgctatgtgctaggtactttgttacccagagaggaggaagagaaagtgcatatctaaaaaagatgaggagataaatcacagccatcatggtaggctgaaaacatcgtccccaaagacatccatgtcctaagccgcagaacctgtggatgttataacacatgtaaagtgcccacacgtggcctggcatgtagttggagttcaagtattagtcagcattaattgtaaaaaattattttgttttctaacttaaaaatgtttttactaatttattttgaatggacaaataacaattgtctatatttatggagtaatagtgaaaaatttgaaatgacttcataaacgttcatcaagatggggaaggactatattacatattatatttaatgagatgaatttatactgacatgaaaaaattatgaaagattttaaccagcatggcccttatttcatttgtatagtttccatggcagagggtaggaataatttgggcaagcacatttaaagcttcaacttatatactagggtaaatcacatccactcatattccactgtccaaggcaaatcacaggggttcttcctattaggaagcactgcaagtcacatgactaagggcataaatgtataaccatcttgtggggagaaagtggatagttaggaacagtaatacaatctatcaaagctggttagagcccaccatggagtagatatcccacactgtgtgtgtgtgtgtgtgtgtgtgtgtgtgtgtgtgtatgtgtgtgtgtatttctgtttacttttatgacccatatctgtgggccacacatatggggaaaacactatgcctgtagacaccccaagcaaatgagattaccatggaacctcaataatgagggataacttccaatttcttaattctccactgatgagatgtggatacttgagtgatccccaggctcattcccaagtgaagattttcagtccttcgtaataccttggacattcaaatttgtatttagtttcttgtgaaaaaattttcatttaatttttacaacagcattataggatagctactattatcctcataattcactatgcattatgggcctttcagaagcactctgattgttaaaaccctctaattaggaagcctaattagacatgccatttttgagcaatttgaggggatagaggtggggaacccccttgcatcaaagttataactgtgcctcagggatagatacatgtgcaacagaacccagaataggtatgctcatttttcaaaactaaaacccaggctttatagggttagggtaaaaaaaatggctttggattcttgtcaatcagaggaagaagaaggtcatagagagttcttagggtcataattttacattgcctaaaaatattttagagtagggtgaatcatgagaaacattttggcttcctatggtatattattgagacaacctgtcccctacatggaaatattgtcacgggattcttggggtgttgctttgtgagacagaaacctctgtggccattggtgcttttgcacaagttttgctcgagcctattgggcttgtttggtccattcagcctggcaggctgcacatggctcatgctaccagcctggatcccatgccagccaagggccagccagatgcagagcagagaggggtgtgtgagcaaatatgaggtccagccactatgcacagccaggcatgccagctgcggcaaggcaggcagctccaggtgccagtatgggcactgactccctgtgaggctccagctggaccaggggtgccacaagcagatttcatggctggaactggagaatgcagtggtgcctggaagcttggagatgccaagagctaaagagccccaaagagggtgtcacagccctggctcagtgagctcctaggtctgggcttcccaaagggctgcagctcctctctccttctctcttctctccttcttgttgcccacaatgtggcaagcaatgggcatgtttcagccctgtttgtgttacaagtcttttagctccaccatttggcgggtcctgagttcttgtcctgcgtccaagtagaatgatgtaagttgacaagtggagggtaagcaaggtgaagagaaactttattgagtgacagaacagctcagaggagacccacattggatagttcctctccacaggcaggttgtcccattgagtgttcagttctcagcagagaggagaccctggagtgggtagctcctctctgcagttggttgtcccaatgtctgcttagctctcacagagaggagaccctggagtaagcagctcctctccacagctggcaggtcatcattgtcaactcagctcttagcagagagtagaccctggggtgggtagctcctctctgcagctggttatcccactgtctcaagtctggctgagtctggggcttttacaggcctcagaggagaggaagtgtgcgccaactggtccataggcacccagataaaacacaagttctcactctggtttttgggaccagcagcccagcctccaggcttcaggccctccccagcttgagggtaggtcttcactggtgacctgctcccttccacccaggagactgcctcctgctggcattcacagcacccaaactgtttgtgcaaaggggcacctgcaggcaagcacagaggctgagctgcccccagcacccccttggcctccctcccatgctggcacccaaagtcctgagggggccaaagccatgtgtcagtgctgcctggagtgggtgcacacctggccaggctgcaatagcacccagcctcagctccaaccttgctctgggaatggagtgggtgctgggagcagaaagaggccaggcaatgggaggagacacttcttagcctgcaggaatggggtgggaggtcttacagggcccccaagagtgcagagatgcccaggtctgcagctgtggtttgagcagctatagctgcacccaggagggtggggctcctgcctgctccaggaacccaagagcacagggaggccgagttggtggacatgactcaggcagctgcagctgtgcctgagagggtagggctcctgcctgcttttagccccaaagagcacagggatgcccaggtctgcagctgcagctgggcagccacagctgtacctggggagcaggaagctcctgccctgccaactcagaaggaggcagggcctccacctgttcctggttcccccagctccatggagctggcagccctggtgtgccacccccattgcaagtggcatcatgacagcagctgctctagataggccgtcactgccatcaatatgtcacaaaagttaaatttccagtttggcaaactcaaaagccttcagggactagctgggcagattgcataaacgttacactgctggttggagaacataaagaatgaaattctgggtgaccaatgtgatggcatggcatgacagtcaaaaggcatccagttaaaaaggaaaacactgtcctttcaagcaaaaagaccgtgggcaaattttgatgcctacaatttctaaactatgttctcaaagattaacttgataatattactattttacaaccttacctttgatagtaaaagggagtggcaattctctgaggtgactgggcaagagtcctgtgaaaccaacttactttttttctatacttctatactgtggtatattttccctggctttctgggttctaaatttattacatgttatttcatgacaaagaggtatactggcatcaaaagtcaaaatacagtttttcatttcttgcaagaaagaaaacccaagttaagtgtttttcatcccagcacaaaaatcttccacccatgggcacggacctaattctaacctaagctcaaagttccaagttcatttactcaagaggtctgaataaatgtttactttggtcacagcttttatccaatttccgtatctgactcactaggtgcttctaactggtgccctgatgttacctaacagagcaaggatacaacaaacagcaaacataatttgtttcttaatctgtgcttaatccatgcttgttttggtaatgtctgcacatgctaagtcccactgacagtgttagttggttagcattaatcttatggagttgctgttgccaaaggacacatcctttctgtggaggaataaaacaattaacaaaaacagcatgattgtataacctgaacaatgaatgaaaaatgagttgaggctaaattttattctgggagttaatcacgactcacagaaaacactggaccagcttcctaaactttctgtgccttggtttgcccatctgtgaaatgcactctctgtacttcaaagttataacaatcatatgccctagattttaaaattgttccacaggcacctcattcaaacattcaacaatatttattgagggcatactattgtaatgcctaaccttgtttttactaaccctgtttttagattctctctttcctttaatcccctagccttgtttccacctgaattgactgtcccttagctaagagagccagacagacttcatcttggctctttcactggcagccccttcctcaaagacataacttgtgcaagctgactcccagaacatccaagaattcaattaactgataaaatactgtggcgagcaatatccgcagttcccaggaattcgtccaattgataacgcccaaagccccacgtctatcagtttgtaagagtcttaaagcccctgcacctagaactgtttactttcttgtaatcatttatccttttaactttctgcctactttacttctggaaaattgttttaactagaccccccctcccctttctaaaccaaagtataaaagaaaatctagccccttcttcagggccaagagaactttgagcgttagccatctctcagccgctggctaaataaacagactcttaattcgtctcaaagtgtggcgttctctctaactcgctcaagtacaacactatgtgcccagcactgtttgtacaaatccaacacatcccaccagttgctcgggccacatccctgaacccaacctttgcttcttcatttctcccagatgctcaatcagtgaatcctataggctctatcttttcaatagatctagtagcagaccactactcaccactccactatcaccatgctggccccaaaactatcaactcttgcccagactactgcaatagtttccaaactgcctccttccttccatcctgatcatctacagatctcttcatacagtattcagagcaaaacttttctatgtgtcacctcactggcagacctggagtctctcagctacctttcttagctgtattttaggtaccagacttagtataccaacagtctacctggcttatagctaggactctatcatctggtattctgttacaacaaatgtactttaagttaaaaataataaacaggcttatatttaagtggcaagtgcttgatatggctgctttagcagataagtctactggtagaatctagaggagaggaaataagtcatacatggagaccaagatgcaaaaaccactcatgagcagccacataggacagaggtccctctggagaagccaccaaaggatataaatctctcttcaggtttgttttgagaaaacacccaagcaggaaagctgctgtacaaaattactattgccccattatgcgattgtgttttacttttgtcttagcattaatcctaccttgtggggaaaagaaagagagctcagactgctactgtgtctgtgtagaaagaagtagaaataagagactccattttggtctgttctaagaaaaattcttctgccttgagatgctgttaatctgtaaccctacccccaaccctgtgctccctgaaacatgggctgtgtccactcaaggttaaatggattcagggctgtgcaggatgtgctttgttaaacaaatgcttgaaggcagcatgcttgttaagagtccactccctaatctcaagtacccagagacacaatacactgcggaaggccgcagggacctctgcctaggaaagccaggtattgtccaaggtttctccccatgtgatagcctgaaatatggccttgtgggaagggaaagacctgaccgtcccccagcctgacacccataaagggtctgtgctgaggaggattagtaaaagagaaaggaaggcctctttgcagttgagataagaggaaggcatctgtctcctgctcatccctgggcaatggaatgtctcggtgtaaaacccgattgtatattccatttactgagataggagaaaaccaccttaggcctggaggtgggacatgtgggcagcaatactgctctttaaggcattgagatgtttatgtgtatgcacatcaaaagcacaggacttttttctttaccttgtttatgatgcagagacatttgttcacatgttttcatgctgaccgtctctccactattaccctattgtcctgccacatcccactctctgagaaatgcccgataatgatcaataaatactaagggaactgaggctggtgccagcgcaggtcctctgtatgctgagcgccggttccctgggcccacttttctttctctatactttgtctctgtgtctctttttttttcttaagtctctcattccacccgacgagaaatacccacaagtgtggaggggcaggccaccccttcactacctgatttttatttattgcttgtctcctccttttaaaatgtaagatccaggagataagtggcctctatcttcagtaccatagagtgcttggcacatagtatgtaattcagtcagtgtcaggcctctgagcccaagctaagccatcatatcccctgtgacctgcacgtacacatccagatggctggttcctgccttaactgatgacattccaccacaaaagaagtttaaatggcccgtctttgccttaagtaatgacattaccttgtgaaagtccttttcctggttcatcctggctcaaaaagctcccctaccgagcaccttgtgacccctcactcctgcccgccacagaacaaaccccctttgactgtaattttcctttacctacccaaatcttataaaacgaccccacccctatctcccttcgctgactcttttcggactcagcccacctgcacccaggtgaaataaacagctttattgctcacacaaagcctgtttggtggtctcttcacacggacgcgcatgaaagtcagtatttatgaatgactcaagacacaaaaatagcttcataaaacagtgctttgcttgagtttttatgaataaaccaatctgaagtcatcccttttctagctcagaacaaatttctcccttttattttagaggaagatgagaatggagggtacaaatttaacatgagtttactgaagaaggaagcaccaagattaacctaaatgagaatactattctaatgacattagccagagaataatatcgttcctgttccagtactgccaattaccattacaagtcccaatatcttcatttacaatgtggggacaattataacacctaattattggttattgtgaaggttaaataagaaaatatacttaaagcccttaggacaccacccagaacttcatcaataaatgcagctattttgttattatcatatttatattagtggtatactacatcataaatccactcaaagctgatgctgagtcacggtgacccctaactgaacacattgcctcaatctgctccccataatgcacttgagatacccactgccacaatgacgtctttggtgattttaatttactactattcagaggttcccaattttggcctacaggtcacaggcagtaagaaagggatttcagggactaaatcaatttatcactaggtaaaccgaacaagaacagtttgatcttatcgtgaatcactggagggcacggaacaagtcttacttctagaacccccagggcccagcggagtgtctgacacatgatagtcgatgttgattaaataataaatgaatgatgaacacatgccacctccttgacgggcagttcaggcaatcagacgtcctgtgcgtgatcagacgcctagcgcttcagaagcacgactggtgagaactgggcagcccttccacgctccgcactgcaagaactgcctgtccggaagggtgactgcaccagctccgctccggatatcttggcaggacgcgccctctggcggcgcctcgctcataggtgggccccagcgcgcagtcgcccgcccccgcgcgttgggaagttgggagggaggtgcgcgcttggccgcgcggggcggggcctctaccggcccgatggagcgcgcgggcgctactagccgcgggggccaagcgcctggcttcttactgcggcttcatactgagggccgagccgaggcggcgcgggtgcaggagcaggacttacggcagtgggggctgacaggtgagcgggctccgggcggacttcggccaggcgggccaacctattgggactgcctcttgcgggccgggggcgcagcgggtgggccgcccggtgggcagtttacccgcccgcgccagggccttccttcgctcctgccgtgggcggagagaaactgcgcccgggcttggtggccacggcccccgcctgcgcggcgcgcggggccggcggacgccagatgaatgaggtcgcgggcccggtagccaggcctggcccctggcctgtggaggggaaacgtggtgagatcagcgccacctgcaggcctccgctgaagagttggacggcctggtgcaccaaggatgtaggtttccagttgctgttccggtgggtttgggtcccggcctggggagtttattggttgcttctgtaaaacgatcaactcatctcccagcttcagcttctccgtttactgtgcgcgcgcagttattggagaattcgccacggattaattctccggatcgagttacgtgcggtagtgagcggacaaactcaagcaaagcactgtttatgaagctatttttgtgtcttgagtcattcataaatactgactgaaccacgtactatatgccaacttagcttgtccgctcaccaccgcacgtaactcgatttattgacactagcccttacggagagtctgcaaagcgcgaaccttgcatgccccccagccctgccgctgcatggctgaccatacttcctgcagctccgagaccccgctctcctcctgggtctgcgctgactcgccgctgaaccgccccagcctcgttttccttacttataagttgggaacgtagtgtgtgctttgactgtattgacagaatcatgcatcagtaataatacagtcgtttattcattacttattgaatgctactgggagcgtattcttaggcattggctacaaagatgagcaaaacaaatagggacccttcctacctagagttttagactagtgagagtgcatttaaaagtataaactaatttatttaagtgctcagtaccacgaaagagtaaggtttgtcattctaggaatgaaacaaaaggtgcaattctgtgttcagcttagaagactgaaagatgaagttgaatggagaggacgctgacatgaaagagaaagacctctctccttgattccctgagtctgtaagaatgtgtggctgtaaggagtatgtatccagttttaagtatgagcttgtagactggtctttttatgtttgactttatcttaacgaaagtttatgtttgtgggtttgcctatttccttgcaagtgttgggaatggttctttaagaacttgtgtgagagagggctcagaaaagtgtgccagttgatacttagctgtggataatatgccaggagaaacgtacatatgggcaagtgttttagtgaaaatgaggagacaagaggttgcaagtttgagtggatggaatggagtgagtaaattcagaattaagtaggcaaatgtggcaacttggataaattggtagtggagaaggaaaatagaaaagcagagtcaaaggaatggctactgaatattataacttgtaatttctatttctgtttaccagaataaactagtgttatgagaaactattcttcatgagttggttaaaaaaattcttactactttttttttcgtttggttacagaagtagtacgtattttcagtaaaacattcagggaaatagcctatgcataaagaaaataaatattaatctccataatctccttactgttaacatgttctctatcctgtataatttcttttactttctggtggagggggaaggtgaaaaatggagtttcatgtacatttttttgggaaatcataactttttttccttatcattcagtcttcttcaacatcattcttaatggttacagtttttcagtatatggatgtaccatagtttagacagtccctcttcttggtatttaggttctttttttttgctattgtaagtaacataaatatccttgtaaccaaatatttattataggtatggacgtttaattcctgaaaggtaccatttctagaataaagagtatgcaaaatttttgcttatttctctatactctcagcaacactggtattttctaatttgagaagttaatatgctatcgtattgtttaatttaatgtttatttggttaccaatattgatggacatttggatattcatctttggatcatgaagttaccttaggacctttttgtttctggaatatgcagacctattacttcttgctgttttgcttgctttttcactacttgtcatctccctgacagaagggcaaaagaatctacatctggaggttaaaaagctaaagactacctttcccagaccccactgtagtttggttgtaaacgtgacttggctttagccaggcacgtgactgggagatttggaaggggaaagtgaggggaaggacacagaggggtttggattttccgcttcccacttagctactacctcatgggtctctgggagggtacagagcattcattttgttatcatggattgtggctgcgttgataggtccctggggctgacagtaccgtggcctcctggttggttcctggcttccaggtcgtggaggtagatacttccttggtgtgtccatactgtggtgcttgatttagcagttgtacccagaagatcagcctagatgttactcctccaggcctttcgacaattttgtggtgatctaattccctgtattacattcctttctgcctaacctaccaagggtaatttctggtttttgctgttgactcctaagtgttaagtattgttatctttgtggatataattacatattatttttgaaaattcaactttttttttttttttgagataaggtctcactctgttgcccaggctggagtgcagtggcccattgcagcctcgacctgggcttcagtgatcctcccacctcagccttctgagtagctgggactacaggcatgagtcaccagttttaagaaataatacggaaggatcccatgtaacctttacccagtttcccctcgtggtcatatcttgcaatgtggcacattatcacattgtgtacacttgcaatgatggtacactatcacaacaggatattgacattggtacagtcaagatccagaacattttccatctccacaaggatccctcaacttgcactttgatagctacactcacctcccttctacctcaccaattccttaacccctggcaaccactaatctgttctccatttctataattttgtcactttgaaaatgataggtgagtaaaatcatacaatatgtagcctttggggactggctttttttcactcagagtaattctctggagattcatccaggtcgttgcacgtatcagtagtttctttttattgctgagtagtactccacagcacagtataccacagtttgtttcaccactcacccactgaaggatatctgagttgttcatagtttgtggctattgccaaaaaagaaaagaaagatattgtaaacatttgtatacagattttgtatgaaaataaatcttcatttctctgtaataaatgcctaggagtgctgtgagtgggtcatatggtagttgcatgtttagtttttaaagaagctgccaaactgtttccagagtagctgtactattttacattcccaccagcaatgtatgactgagtttggattctttgcatccttgccagcatttgatattgctacttttttatattgactattctaatgtatgtgaaatgctatctcattgtggcttagatatgaatttccctattggctaatgaaatatgtaacctctttgataaaatgtctttttctgtcttttgcccattttaaaataggatcctttgttgttgttgttttttcactgttgagttttgacatactctagtctttatataatctagatactaatattttctcagatatatgtcttacaaaagttttaaattttggctaaaatttatcagtttatcaattttttctcttatggatagttttcttgttgtttggtgtcaaatataagaactcattggctattcccagatcctaaagagttttttcctaaaagttttacagcttcttatttaagtccatgatctactttgagttaatttttgttgcacaaattttgatatgttgtattttcatttttatttagttcagtgtatttatttccctggagacttcctcttttgatggactgtttagaaagaagtgtgttgtctagtttccaagtgttgagagatttgcctctaatgtttctgtccatgaattctaattttattacattgtggtcagagaacatactctgtacaatttcagttcttttaaatgtgttggggttttctggccctgctttagtttggatatggattatctgtccccaccaaatatcatgttgaaatttgatccccagtgttggaggtggggcctaatgaaaggtgtttaggtcatgggggcaaatccttcctgaatagattaatgctctccctgagcagggagcagagagagtgactgacttcttacttactagcttccagaaagctggttgttaaaaagagcctggcatcccccacgcctttcttcctctctcaccatgtgatctctgtacatgccacccccacttccccttctgccattagtggaaacagtctgaagccctcacctgaagcagatgttggtgccatgcttcttgtacaatctgtagaaccatgagccaaataaacctctttttatttttaaattatccaacctcgagtattccatagcaacactaaatggactaagacaggccctgaatatgttgtatggtccatggcacttgaaaacaatgtgtattctcctgtctttgggtatcagcagagctgcattcctttctggaggctctaggggagaatatatttcccagcatccagaggctgcccagatcacttgactcctggcccctttcctccaacttcaaagccagaaacattgcatctctttgatccttctctagccagcttcctctctaaccacagctgttaaagtttctccgaatgatgcatgtgattagattgtatgtccattgcgttatccaggcccacctggataattcagggtactcttccatctcaagccccttaaccttgattatgtgttcagaatgccttttgccatataaggtcacatactcactgatgccaggatcagggcttggacatctttgtgagggccactattttgtctaccacttcttccttttacttttcacttatttaattatttttgggttgaatttcttgtagacaatttataattgggttatgtttaaaatccactctggaagtcttattttttttttttctttgagacggagtttcgctcttgttgcccaggctggagtgcaatggcacgatctcagctcaccgcaacctcctgcctcccaggttcaagtgattctcccacctcagcttcctgagtagctgggattacaggcatgagccaccatacccggctaattttgtatttttaatagagacggggtttctccatgttggtcaggctggtcttgaactccctacctcaggagatcctcccgcctcagcctcccaaagtgctgggattacaggtgtgagccactgtgcccagccaagtctttgtcttttaattggtatacttacaccatttatatttcaagtaattattactatgtttgagcttaactctgccatcttatttttattgtttttagtttatctctgtttctttttcttgccttcctgtgaattatttgaacattttttagaattttatttttgtttatttacagtgttttttagtttatctctttgtgtagctttttagtggtcgttacgggtattgtatgtaaatgtacgtatgtgtgtataaaatcacagactactgatattgtcattttacttatttgagtaaagtatggaaacattacttccctttatataaacattacttccctgtatatctatcttccctttgtatttatagctttactttttgtttataattgtcttaaatatttcctttagaaccacatcagacactgttataatctttgcttcagcggtcaaacataattttaaaaactcaagaaaaggaaaacctattgtatttacacgtttttgaatgctgcattctcaccttgatgttccaaggttccatcttttatcatttcctttttttccaagggcttcctttagccattctttgagggtaggtttgttgatgataaattctctttgttttccttcatctgagaatttcctcttcattcctgaataccatttttcttgattacaggagtctggattgacagttcttttctttcgatatttgaaacatgttgtggcatttctttctggcctttaagatttctgacaagaaatctgcttgcatttgaatagtttttcctctttaagtaaggtgttgtttgttttttttctggctgcatttaagatattttctttgtcttttgttttcagcattttaataattacatatcttggtgtgtatttttttttttttttttttttttgagatagagtctctctctgttgccaggctggagcgcagtggcgctatctcagctcgctgcaacctccgcctcctgggttcaagcaattttcgtgcctcagcctcccgagtagctgggactacaggcacccgccaccacgcccagctaatttttgtatttttagtagagatggggtttcaccatgttggccaggatggtctcaatctcttgacctcgtgatccgcctgcctcggcctcccaaagtgctgggattacaggcgtgagccaccgcgcccggcaatgttttgttatgtttgcggtttactcagtttcttgaaactgtagctctttagccagatttgggaagttttcagctattatttatttaagtactttttcagccctatcctccttcacctgtttttattggacaacattgaacaaatgttagatcttttgtggtagtcctgaaggtcccggagggtcatttgttttcagtctgctttctcttctgattgtaatctctctataacttctattctgtagagttcactgattctttcctcacttccttccattctgctgttgatcccatcaacagcatcagtagccttttattttggttatattatttttcagtttttaaaatttccctttggtctttatatcttttatttctttgctgaaatttctgtttcttacctgaggtttcctgtttttttcagttgttcaagtgcattcataactacttgttgaagcattttatcattactgctttaaggtctttgtcagataattctaccgtctgtgtcatctgggtgttggcacctattgattatcttttttcgttcagtttgaaatcttcccagttcttgatataatgaatgatttttataagaattggagccaggcattttttttaaatcatgtttaaacctcctgtttgactgtctttgtctgatgctgctctggcaggggaagagggtctgctgccttgttagtgccaggtggggatagaagtccaggctcccccttcagcctctgtccacatctggggattgggaaggggctcctccatcctgctgggtgagggtgggagttgtggctccctcctgagtctctactgatcctgcaggggaaagctaaggggtagggcctcgttattggttggtggggataaaaatcccagctccctacttggccttctcttataccatcctggctggggtgctggggcactcgttgtagctgtaggtagaagtctatgctttccacttagcctttgctggtgggaccacaggtttattcctgtggtgtttactagaatagagcagttattatataaaagtttcctgtcttgctaggctgccattttctagctggagcaggcttgtgaggggtgggggtggtatggtttggctgtgtccccaaccacatctcaccctgaattgtaataatctccacgtgtcaagggtggtgccaggtggagataattgaatcatggggtcagttcccccatattattctcatggtagtgaataaatctcacaagatctgatggttttataaatgggagttccctgcacaagctctcttgcctgctgccatgtaagatgtgactttgcccctcatttgccttccaccatgattgtgaggcctctccatccatgtggaattgtgagtcaattaaacctctttcctttataaattacccaatctcaggtattattagcagcatgagaagagactaatattgggaggtgttcttatttgttttggttttggtctacatcagttggtgtttccagttggctgatttcttgaactgtcagactgggatatataaagcaaaaataaattccagggaacttactaccctgccttccgcaggcccaaggtccctagccagtctgcttcttcactacacctttcagagttttatgcttgttttctgtagcatgtctagggtttttatttgtacttagcaagaggaataagggaaagtaagtatactcccatcagaaacagaaatctctgaattttctgattataaaatggggataatacctactccatagaatcattataagcattaaatgagatactgtaatttatttatttatttttattattatttttttgagacagtctcgctctgttgccaaggctgtagtgcagtggcgcgatctcggcttactacaacctccgcctcccgggttcaagcaattccccctgcctcagcctcccaagtagctaggattacaggtgcccgccactacacccagctaatttttgtattatttattagagacaggttttcaccatgttggccaggctggtcttgatcttctgacctcaggtgatctgcctgcctcagcctcccaaagtgctgggattacaggcgtgagatactgtaatttatgtaaagtgtttactactactctggtatttgtaagtgcctaagaaaaataacttattttttaaattttgtacaattatgtattttgaagatttttttaaaggtataagttaaaccagatagttatgtttttgctaatagttcttatataaagtatgtttaaggtctttcaccttcccaagatatggctattctttgaaattggatttttttcaccaagggaaagagaaaagagagtaagttccgtattaatttcacacgttttctgccatccctgtacacagttaaataccctttgtgaaacatcatttccattcttaaaaacagcgcttctgtgttgaagcattattcagtgtagtcctaagttttttcctttagcattgatggcatatttaaatgggtgcaattaaacaagcagacacatgtacaatccatgtgttgttgctctttgttaagttgcatcagtaatgcctcatttcccagaatggacactggtgtgagtctcaggcagtatagaggccagatcccaagttgactttctcatttatcaagtgaatcaggtaacaatgacaggctactttggggctttgaatataaaggtgaataagtctactcaaaaagtagtttggaagtcagcagatgtttagatatccataactcctcagcaaaagatacgtccagtgaggtttagggttatgtgaatttaggctgtgttcctcattcaaactcttagaacattgcctctgcatgtactgaaatgtctgctcttcggatttgctgtattttttgtttctagggattcacctacgctcttaccagctggagggagtaaactggctcgcccagcgcttccattgtcagaatggctgtatcctgggagatgagatgggcctggggaagacctgccaggtgtgttactatgcgacgagtactgctcaccgccactgcgatacttccttataactcattctggagctgagagctctggagctaaaacaaagctcagtttcacaaatgtccctgggatccaggctaactggctcttgcaccgggaaagggccttccctgtacagtcttctctgcctcagtcattgcagttcccctactgactttattcagggccagcaaatgctacttgtcctttctttggatgttcacatagctctgctttaagctctctaaaaagatatcacctccaaatttgttttgctaaaattttgtttagactttttgcatctatgttcatgaaagacattggtctgtaattttcttgtagtgtcattatctaattttagtattggggtaaagctggccttgtagaatgagttgagaagtatgcccttctcttccattttctggaagagtttatgtagaattgctgttaatttcttccttaaattcttgctagaattcactagtaactccacacttgttttgtagacacatctggtttatagtaataaaagataaactttctctaaattgcatcctcagggaaagctagactgaatggttttaattcaataagccacttattaaagaatggttcctggcacagcttgggctgagaagccatagataatttaaaaagaaaattatttctgttataaaaactacctaccaccctgtaatcaagcactctaaccataaccatgagttgcaatgcgtgttttgcatgattgaacttttgtttttgagacagggtcttgctctgtcacccaggctggaatgcagtggcatgatcttggctcactgcaacctctgcctcccaggctcaaggaatcctcagtctcctgagtagctgggactacaggcgcatgccaccatgcacagcttatttttaaatttttttgtagagatgaggtctcactatgttgcccaggctggccttgaacttatgggctcaagtgatcctcctgccttggcctcccaaagtgctgggattacaggcgtgagccactgcacccagcccatggttgaaattatagtgcgtatatagtttgtattttgttaatctaacagtgtcactgtaattttttacttcgttatattcttcacagtcattatcaacattgcataatattccatcaagagaatttataatttacttaaatgttctacagacgagaaatggtgattcctcccctttttgtgctgtttaatcttgataggaacatctttgtgcttgtagctttctcaggattttgaattatatccttaggacagatttttctcagaaatagctcagcatttgaagatggagtctcttgacacatttttgttttaaaataggttattttctctgtatattacagcaacattcaagtcataagtgtgtactagaatcttctgaagtatgcccatttgcctttaccaatatttccattttatacccttccttaagcttaggatcgtgtattgtctgttttccccgttagaatgtgtcctccaggagggctgggcgttttgtcggttctgttcactgttgtataactggagcataggacagtgcctagcaaatagaagacaccctgtaaatacatatggaagaaaggaagacagtaggggaaggtgggaggaagtgagggaggaaggaaagcatcctccctcactcgggaaagcctggcaggcagcagagggccaccatgcgattggccgtttttacagtcatatcttggcacttcttgcttaatgttttcagagtatcgcagatcttggccatcagttggattttcattgatttctattgtctttcctgactttttctttacagtagaggttcaattacctaaacattgagcctcattgcttgttaactactgaagtaattgagttccataaatttccgtgcaagtatattgaggcttacatgatttcgctctacgaatggattactcccctgatatgcggaagttcgtacaatatttctttgtaaaacaagtcttaaacaagagtgtgtgttccctacagggttgtgggaacttcatggttgtttctcatggggaaatgtgatcaaaactgcctttctttttctgtgttccagactattgctctcttcatttatttggcaggaagattaaatgatgaagggccatttctgattctttgtcccttgtctgttttgagcaactggaaagaagaaatgcagaggtacagagtagatgtagctgaaattttattgtttatcttgattaagattttttttctggatgatgtataaaatatgataaaacaacctattgtcgtaattagtaagtttattccagaaaactttgagctgatagagtgtaggtagacactgaggatataataggggaagagtaatattattactatttggcaatttaaaggtcagcaatcgtttgtagtaagtattgatgaacttagtagaagccattgttttttgtttgtttgttttgagacagagttttgctcttgttgcccaggctgaagtgcaatggcacgatcttggctcaccacaacttctgcctcccaggttcaagtgattctcctgcctcagcctcccaagtagctgagattacaggcgtgcgtcaccacacctggctaattttgtatttttagtagagaccgggtttctccatgttggtcaggctggtctcaaactcccgacctcatgtgatctgcccgccttagcttcccaaagtgctgggattacaggtgtgagccaccgcgcccggcctatttttcatagtgacgtaggaagtaactcatgtggaagagatcgttttatttttagagtcagcacaagacctttttagatctgatccctctacctgttcacataggaactcgctctgaggttcaaccatttttttagataagattcagagccccaagactctggttgtaggacctcatgagttctgtacattgcaatcctcccatgaaatgtaattttccagatatgcacatcctgtcacatggatctagtatttatgtttatctacttcttttcttggattcagatttgctccaggtctttcctgtgtaacatatgcaggcgacaaggaggaaagagcctgccttcagcaagacctgaaacaggagtcacgttttcatgtgctactgactacctatgaggtattcattcgtttctctatagcgagaactcctaacctgtgaccttagaagttgtagagtctgctgaaattatatttaagttttgttgagagcacacacttttctgggcagggagtctaccttcatcagattctcaaaagagggctgtaaccaaaagaagtgaaggatcattgtgcttcagattagttcgatcttttcctttcttggtggatcaagggggaaggcttctcaaggaagtggcacttgagctgcctcttggttgatgaacagaagtcaggcaggcaggcaggggaaagggttttgtggactgaggaatcacgtctgttactggaggataggaatggaagacagctccggccttattttaaatccttgtttttcagtctaagacagtgtgtgccactgaccttccacttaatcaggcttttctctttgtttttaagatggcgctacttagaaattattctcagaacttttttttacttagtgaacaaatgagacttagataaatcctatagtttaagagagttcacagaaaactagcttatcaatatcagagtttatcaatgccagcctttatacgtgtcttcctaatttttcagatttgcttgaaagatgcatcatttctaaaatcgtgagtaggttgtactatttaagaacttgggttgaatgtattatgaatgtcatgtctttccttcacgttttagtactttgcctctcctggcatgtctggtatgtcttccatgagttctgtttatgggtaggcggcatggtgggagtcctgtgtttacagtcctctactcattagctgtgtgtccttgggttagttatttaatctccatgaacttcagcttcttcatctgtaaaatgaggataattgtttcttacctcaaatagctgttacgaaaattaaatgagattaaatatactttgtatggttaatagatattaggctctttacatgcaacttgcatagacccctttcagtactaccatttggagagtttgctgtaatacagaaggagaaccatttgagctgtttgctggacataacctaaaatagcaatcagtgccgtggaattaactttttagaaagggagttttaagtgtacctctaattagttaacctcatattggcccatgaaatcagaaactcagcaataccacctaataatgggaatgataggatcatgtcaagataacagttacaatgcagattaaataagggctagagtttaggtaagaaagatatgttgacagggtttcattctctataacctctgtagttattacatggttaggtggatattctgtattttaatattcaaaaatctttgttttcaaagtattttatcaatattttaaatgttatttcttatccaggttcctgtgagctggatttctattttcatgttattttgaaatactagaggctaggtcatagatttcatgacttctatctagtatttcatttaagtgagcatattatcttatttttcttaagatatacattccctctctttttattattaatattcaacttaatatttgttgaaagtcagtcactggaaagacattgttctgagagttattggcaatatcaggaaagtaagtcatagagcttccctaagaagacaaactccagtggagggatgagaagtgtacagatatccataatacatagcaatatatgggaagtctcaaaagataataaaattgggacataaatgttgctgggtactttacataaattatcccatttaatcttcatgaaaaccccacgaggcagctattattcattttacgggtgaggaaaataagagatttggtaacccatccaaggttacattgctgatgataaatagcagagcagacatttaaacccagcatttggtgctgtggagcctctttttaagagaacttctcaaaatagctagttgtactggagttttacattattcagcagaaatagaatctttctatttcagatcatcggttttcagtgcattttcaggtagatttaaaaacctaagtaacagagggacatttataatgctgtcctgtagtatgaatcccaacaacatagatacattctttcaatatatttggaaggttatattgcttattgctgtattgtacattctgagaatagcagggaagtgtaatatcatctctgccctaaagagatttattatggagagttaaggctgtgcatgttacaaatatgaaaaatttgaaatgttttggacaatagacttgtaaaactctttggatcaagaggattagaagttacctcatccaactttccattcagtgctggatttcccccatcttttcctcttcaggggacatcatttagagtatcctttgataagtgatttgacctacttcctttcatgagccaaaatccaccactctgtagcctgtttcactgaacaagcattttttggacacctaaatgtctagttcttcacaagggaataggacctaatctgttttgaaagctaattcagacagagccaggcaccatcctagagaaacttccataccttatctcatgaccactgtgcaacttcaactggacctttgtttcttgtcatccttaaatgcatcctctgctcatgccacccaaccttctccttcgacttcctgcactctctttggaccctcagtcctccctctactcgcttctctcagtaggtgaatggtaatgtcatagggacctctgttcctctgcctgtcctctggagtttctctgtagcctcaggaagagggcctcctccttgtaaggtgaacctctgctcaagatctttctctaattttggaggaattttcctttccatacctactatttttccagtgttctgttttacctgtatatacatttagttttttaaatatgaaaataatgtaatgggattccagaatgtttataatcaaaataaaaagttaaacatcttataattttcactttattatcttttgcatggctttcacatttgtaaaagaggatacatgatatttatatcttttttattattctataggccttttaaattgcaacataatcatatttattatttaaaatgccatgtaatattttactacctattattggacatttaggttattttccattttttgctgttttaaataatacaacttgaaacattcccacatatatctttttctgtattttgaatttttcttaaatagcttctcagtagtatctgtcaaagtatttgcttttatgactgaaacttcttgagaaattgctgatgtgacacagtatgctacaaaatgtgctctggcaacagccactaatgacttccatgtcaacaaattcagtggatatatcttcctggacatctctgtgagatttgactctgctcaccacttacccattttaaagtcacacttcttaagttcctacaacaccactgtctatcttgatttttttcttctgtttgaacatcagctctgtctttatgaccttcaccaagtcacctaacctttctgagctttagtgtctttattagtaaaatgagcacaattgtctgcttgctatactcttttagactaaataacacataaagccctgaggttagtgtctggcacaaagtaggagatcataaatgtttccttttcctttctgtctctggcttcttcctttctgcataggtctttcccattttgttaaaaaaaaaaatcccttggttttactaccttatccagatattgtattatgcacatgtagcctctcaggaaggtaatttggtggcatttgtaatagaaggggcttactgttaagtctttttaataacagtcacagttttgtagtaagacttttgattgtgaaatatgtgtttaaattacacaaaactgaaagcttgggttttctctcacagattcccttggagtgttcttgttgtggatgaagctcacaggttgaaaaaccaaagctccctgctgcataagaccttgtcagaggtaaacttacagtgtagccttagtttttatataaccccttctttttaaatatacattatattttagagtaattttagattcacaacaaaattgaacagaaactacagatgtttcccatgcatatgtccccacacatgtacagctgtcccctgtccccacacttgtacagcttcacccattatcaacataccccaccagagtggcacagttgttgcaactgatgaacctacattgatacatcgctatcacccaaagtccatagtttacattcgggttcactcttggtggtgtgcattctgtaggtttggacaaatgtacaataccatgatatctactgttatagtatcatacagagtagtttcactgccctaaaaatcctctgtgctccacatattcatcttttcttcgtaactccctttaaaaaatactagtttaggcctatatagagtcaattaaattgaaaccttttttcgagttcgatttctgcagggctaaatgaacattttatagaagacagaagaagtactaaatatggcctaacttcttctttcttttatattggagataggtttactaatatctggtgaataagaaccctaccccaatagaatgcattttatttcagatgtttcaactctcttttgattatcttcaaagggacaatttctcttaaaaaatcttattataattcttctttgtgcaatagtagatatatcagacatgttgtacccttccccccaatttacctgttgaaaaaatttgatagttcacctgggttcatgaagagaccaattacatgctattgaatattacctccagtttgtcttgtctttgtcctacttttgagcataatacacttgctttcattcctttctctggatctcttgcatcattctggcaaagtagatgagaaataccattgtaccctagatgggcccttttttccgaggagtcagtgcgatgtgaaataccctttttattgacctggtaaagatttgttcattgatgagaccacatatgttaatttctgtgatgataattgaagtttggtccttgtcctataataaaccaattaataaatttagaggtcacttggaggaaagtcttagatatgaattctatttttactggtctgaaagttgtagtttttagagtcttaatgtagatacgatcactgtgtattattagcccagtctcaaaggtcgctgtcccctggtggggccccctctatccctggtgtcctttgctttctttgtagggacttttaacagtatctccttctgagagcttgtcttggtctgtttttcacagactgggtaattcatatgagcagaaatttatttatcaccgttctagaggctgggaagtccaagatcaaggtgccagcatttggcaagagccttcttaactgcatcctcacatgacagaaggtggacgggcaagagggagcagaagagcaagctatccaaatgctgcatgacacttttttttttttttaatatataaaggccttaatcttattcacgagggaaaagttcttatgaactaaccacctgttaaaggcgctacctcttaataatattacattgacaacacctgaattttgaaggaaacacattcaatccatagcagttgtcatatcctggcatctaaccttatgaaagatggcttcataaactactgtgccagtttactaatttaaaacgggaggagagaagcaggcatagtaaaagaacctggatttggagtgggaaagctaagttctgttgctggccccagagccttttcttgttattcataaggaaactaaggctcagggattaagtgaagaaatggttctgggtcatctaagcattcctttttagatgaagcttgggttgcagataactagttggaaagaaaatacatgtatttattgggctgagatggggagggggatactgccgttttttatttccccctaatattgttttcagtttataaaagttggacgcaaccagccgggcgcagtggctcacgcctgtaatcccagcactttgggaggctgagatgggtggatgacgaggtcaggagatcaagaccatcctggctaatacggtgaaaccccgtctctactaaaaaattcaaaaaattagctgggcgtggtggtgggcgcctgtagtcccagctacttgggaggctgaggcaggagaatggcgtaaacctgagagatggagctggcagtgagccgagattgcgccactgcactccagcctgggcgacagagcgagactctgtctcaaaaaaaaaaaaaaaaaatagttggaagcaacctaaatgtaaaatatagggaattggttgtacaatttatgcgacattcatgcagtgcatttgcaaaaggtaaggctaccaagaacaattatgtagaagaatatttaataacatggaaaatgtttgcaaagtattttatacacacacaaaaaagcttacaaaatactatttacaaacagagatggtctctgaatctttacccagttataaattttgatcccaaaatggacctaactgaatcaaaatgttaatttgtgtcatagggtaagttacctgtagcgactagcagccttggtttcctttgtgacctcacagccttcattcacctcagctctttacttggtgaacacatattgtaagaatgtgaactgatgattggaaacattacttttgacaagttcccatacttgaaatactacaaaaacatcacctaacaagcagaacaaccatgaatgggtagacattgattagacatttaaaaagaaacaaataaaaaagggagatggcaaaaaaaaaaattgtttacatctgttttcattgattgtgttattcatttatcattttttgtattataaaagcagtgtcttcctatggccccccctccaaatcaaaatatagaaagacaagaagaaaaggaaaacatcccagtaatcctactcctacattaacactttaatggtttaatggtgtatgtgctgccataatctttgctgtgtgtatacattcaaaaagtaatgtatatatgcatatatattatttaaaaagtcaaaatgtatattaaatatcaaaatattgtgtatatacgtgtatacatacacgtatgtaaatgtgtatatacatatgtatgtatgtgcatagatacacttacatacatacatatgtatatatacgtttacatactatgttttgacatttaaaacaggctgtaattacaggctcacacctgtaatcctagcactttgggaggccgaggcaggaagatcacttgaacccaggagttcaaaagcagcctgggcaacatagtgagaccttgtcgctataagaaaatttaagaaattagctgaatgtggtggtgagtgtgtgtagctccagctactggggaggctgaagtgggaagatcacttgaaccgggaggaggaggttacagtgagccgagatcatgcctctgtactccagcgtgggtgacagagcaagaccctgtctcaaaaaaaaaaaaaaaaaagatatacatacacaagatgtcaagatatggcttcctcattttgatgtattgtttaattctactaagttcttgtgaatgtcagtttagagaatatcttttgcttgacctaatatcttttcttctttttcctgaccttctacttcatgtctctcttactcttggtgttcttctctgttgttcaaaatttaaggacattttttttccatttgagattctctgtgatctccagagacaccagaaccttcctaaccttctacttcatgtctctcttactcttggtgttcttctctgttgttcgaaatttaaggactttttttttccatttgagattctctgtgatcaccagaaacatccagaaatcttgacatcttgcatcttggtgttcttctttgttgttgaaaatttaaggaaattttttttccatttaagattctctgtggtgctgtgtccagaaacatccagaaatcttgacatcttgcatctgatgcaccattaaattttataaaaggaaagtctcctattataaatcttgcttattgcttgcagtggtggggcctgatgctgtagcgttggattctcaaactgcatgagcatgtgcattgtgtctcagatacctcagtagactccccgacacaggcagtaacacatagtttgaatccccatctaaattcagtaataacagccatattaaattctcatgcaatacttcagagttcacaaagtgttactacatccttatataagtgttttcttcacaggattattgtccccttcttatagttgaaactgaagaggtattatttcatctgcatcaaacagctagtttgcagcttcaacctgagccatctgatttcatgtcccctcagtcatttcattaaatcatgcctctctctgtgtgggtaaaggttgtgatgggtaactcagccttgcattccagtgttatggaatttttattttatttatttatgtatttgagttctcagtagtcttcagtctcctgttgaccggaactcccatccagaacagcctccaagagctctactccctcctcagttttgtggagcctgatctcttttccaaggaagaggtgggagattttattcaacgctaccaggatattgagaaagaatctgagtcaggcaagttcctttcctgcaaatcatccccaagaagccttggcacagaaaccatcctcatgcataatggttataggtagaaaagaaggagaattgatgaccagaggacaccttccagggagacagaccgctgatattagggagatgttaagtcacacatgttgttcccagttgtctgctgttcatgcctctcttaattgtttgctatttgattctgcagtagggcttctttagttcatttttggaagaaatagaaagtgcctgctgatttgcagacttttttttccaacttgtaatttctataaaggctttgttaactttataagtcacttcctgagggagaaaagaatgtgggtgctgtagtcccaaactactgttcagcatactacagcactggtatttcttttaatgctgcaccaaaaccagaattctgggatgggaacccttcctcattcatacagccaagagttgtagtcttctgttcttgtacctttgcccctctgtgttgtaggattatccatctatccctgtgatattatcctgggatgatttttcaaaacaggtaggaggtatgccaactaatgagtttgtatgtgttgggtaagtatgagtttgagggggcttctcatagcaaaaatctccagaccatagactgaagatcacctggcgaacctgctctgattactcccatgttttgggttacctgacaaaatataagacttctagtcaaatgcatgacatacttgtattacatgggacacacttgtgttaaaaagttattcattatttatttgaaattcaagtttaactgggcatctgtatttccatttgcatatctggcaatcctacaggtagtataattctaatttagaataatttttgaaattcaagacatctggggaaagaagggattttaagtcaaagagccaaatttgaatgctggccacattcacatccagctgtgtgactttggataagttgcctaatttctgagcctcacttaacttagctataaaaatggggacagtattcctcacttgaaatttctaagctgttatgctgatcaatgagattaaacgcaaaaatattctggaaacaaaacagctttgtgcaaatgagataagaagttatttgagtgttcctcgttcttgggctaagaacaagtcatgattccagaaaaaagatgatcccaatgaaggaagaaatactataaaaaaatgatcatactggcctagaatgcaaaataagcgtgaaataagaaacaaaaataaatttctttaagttctctagggttcattgccttggttctacttttgtcccacacttcttgtatttttttttcttatgtagcaagtgaactgcacaaactcttgcagccatttctgctgaggcgagtgaaagctgaggtagctacagagcttcccaagaagacagaagtagtgatataccatggcatgtcagcattgcagaagaaatactacaaggccattttgatgaaagacctaggtaatcagagggcacttgtccatttagaaactaaatgaggatgtgatttcaggtagtaaaatattttataatcacactcatttgtatgatcccaagaatatgggatggaattttgtattctgaataattctggtcggctacagtgggactgtggcagagcatcttaaagataacagccttggttgttgcagttgtgaaatttccttttctcccctcactcagtttttcttagtgcctgtaattaagcaaacacttccaggtgtcccagtcatgtctttcatcctcccaccctgtcagatacggtagtccaccctcattcacagttttgctttccagggtttcagttctgcactgaactgcagtctgaaaatattaaatgaagattccaaaaataattcataaattttaaatcaaactctgttgttagtagcatgatgaaatctcactctgttccacccaggacatgaatcctccttttgttctgcgtatccacgccgtcagcgttagtagcctgctctgtcatcagtccaatagtcatggtatcacagtgcttttgttcaactgatctttattttacttaaaaatggccccaaagcacaagagtagtgatgcctgcattttggatattctaaagaagccataaagtgcttcctttaagcaaaaaaggttaaagttctcaataaaaaaatgaaaaacaattatatgctgagattggtaagaacaaatcttctgtctgtgacattgtgaatagaatattgttataattgttgtattttattatgagacgttaatattttactgtgccaaattaaactttatcataggtatgtatgtatgggaaaaaacacagaatacatatagggtttggtactatccatggtttccaatatccactgggggttttggaacatattccccatgggtaagggggaactgctgtatttaagagagtgcaaaacttttttgttgaatcaaattcactgggaggaattggaagtgacaagggaaagatagtgaaataatttctcaaattgcacttttttgtcccttgactccacaacaacagttaaagaaaatttagaatttgcaaaagagtaacagagtacttctgagttctatttacagttgagggtctttcttaaaacaaaatggttgagaaaattttatgtgaacatgctgttaattctcaatacaattcagtgaaatttgggaggttagtataggttcaaaggatataattgaaatgattaaggttacttgtaaaaactcagggttttggtttctgttttgttcagtaggccatctctttctgtctctctctttttttttaaatttcagatgcatttgaaaatgagacggcaaagaaagttaaactacagaacattttgtcccagcttcgaaagtgtgtggatcacccatatttgtttgatggtgagacagtgccttttccccccacattattctttggtaatgtttctgtggccaaatcataccaaaattcttcaaaataattgcatatacttactttgtttactttgtttattctcaatttctctgtattggtattaactcatatattcatgttcagatatcttcagttgtcccggtaatatcccttctggctatatttttctttttttgttaaatccacgatccagtcctagatcctgcagaccctgcattgcatttgccatgtctctttattcttctataatctagaaacattcttcagcgttttttttctttcattacatgaagagtcaagaccagtggttttgtggaatgcatgataatctgggttcttaaaaatcatttcttcttgattagatttcccattgtcttgaattgactcagtcagcctttcctcaccgctactccaggttcactaatgatctccctgttgcccaaccaatggttatttgttagttcacatttcagttaccctctcagaagcctttggcacagctaatcacttctttcttgaagcactttcgtccctcagcttctgggatatactttctcttctccatctgctccttctcagtctcctttgttgcttccccttcatcatacagacctcagtaaattttcccctgggcaccgctttagctgcatcctaggaattttgatgtgtggtgtttttgtttttcttcatactggggcttttttgattccctgattggtaacccttggagcaagcactcctgtggccatggagactctagataggatcagtacagagggcttgctgcagtcattttaagggaatctctgccaaatagtgctaagaactgtttaaagattgcacaaaatctcaagtaggtgcatatgagaactttttttaagaggagggggtgttgggaacacataggttttgaaagaagtcctccaggttattctgactgccattttgacttattttatagagtgagtctcgatttcagttttgggtctccttgacctttagcatcttcttctgtctcagtttcctgaagagtggttttattccttacacagatgtttattaggcttgttggatgtgctaggctgtgtaattggtgttaagcaggactgagatcatcatgcaaacaactacttatatgatgagcttttggcttctcttcctgtagcctagctactggcttctgcccttactgagggcacattactgggagtgggttctttcttttctaggtgtggagccggagccttttgaagttggagaccacctgactgaggctagtgggaagcttcacctgctggataagctactagcattcctgtattctgggtaggtggtaggttcacatttgctgctctgagctaatggctgttaaaacctgactattgaggaactcactgagttgttcaggccaattccagttttctttttttttcttaacactgattcaggttctgccttctctgtgactacactcccaccccattctatcccactccaccccttccacaatcattctttcgtttcctgaatttgtacagcacttataatcctaatccagcacttggcaatgtgctgccgtaatctgctgtctgattaactggtgtttatgtttaccattatcattccaactatatattgtttggctctacaaggacagagacaacactgagcatttcttttatagttgcctgctagtaacttggcattgaattgacacataatgaaggctcagtaaacattcatttttgttaacctgtggggtttgatttaaactcaaggggaacttgaaggactctttctcagggacatgagttgcgcattagaagacgaggttcagagccaggcactgtggctcgcgcctgtaatcccaatactttgggaggctgaggtgggcggatcatgaggtcaagagatcgagaccatcttggccaacatggtgaaaccctgtctctactaaaaatgcaaaaattagccgggtgtggtggcaggcgcctgtagtcccagctacttgggaggctgaggcaggagaatcactggaaccctagaggcagaggttgcagtgagccaagatcatgccactgcactccagcctggtgacagagcgaggctccatctcaaaaaaaaaaaaaaaaaaaagaccaggttcagttagtgttcaacagccatgtgttcagcttatacctaatcctcctagtcaccagagttctctctttctagaggagtctaggaaaagcccagattcccatgggtttcaaaattatccctttggaatgactgtcttaggtatggcctgaactaatctaaaacttcagatttggcaaaattgctcaactttaggaatgtgcaagttaaataatttcatgtcttactgtatttcattggttctcgtatatctgccataagtatgttagagttggagaaggacctataaatgccttctggccagttttttatttcacagacccagaaaggttatatgacttgcccaaggtcacacagccaacaaatggcagaaatgagattagaattgaggttttcaggttcattgctttctctacccatttggggcttgaatcttgaaagagttccccataatttttcctcttacacttgttgcaagctcagattaaataagtttttataatgagaatattgttttgacagtgctgtgcttctttgtttatgcaaatttaaaataacagccagtaacaagggactctaggcttgactttgttcttgacttactccatcattttgccgcctttcttccctcctctcgctatacaaaaattttctcgtgttatggaaaatgagacatcacttaccccttgcttctctaaagtaatgcttctcagacttttcaacccatatagctgtagatgagaggatagtgactttacacccccaaacagggcatagttgtagatgactgaccacaggctttcttcagagtctccagtttttcttttcttttttttttgtgtgtgtatttgaattttgcattttactcttcacatatctgtatttattttgctactaaaatgaaagcttatatttctttccattgagcaaattgacattccagaaagaggcaccttgtttattctagggcttatatcccctgttgcattgacacgtcccctgggaataatctccactctagtttgaggatgactgctctgagggatacagctacctgtggaggtgtattctcatagaaagcatttggaggttctgaggcagtctataaatcatacgacacttatatttctactttggtatttatttataaacttttattgtttggtaaattttgcctgagggaaattgaccttaaataccactagacttggcagtgtttccttttctttttcttgccaggggccatcgggttttacttttctcccaaatgacccagatgttggatattctccaagactatatggattacagaggtgacaccttttggccactacattacctaaggctctgttagacttaacagtccagataggtccatgaagaataatatgggatatgagaatattacaaaggaaagcagggtgagaacattattcagaaccaaaaaatcaaaaggcgagaggagagtgatgtgtgaaggcaaggatggacagcagagaacaggcacgtgggcagaaataaacacccacgttcccatcagttacatgatttaaaattatgggccgtggagcaaatgttgtggaaatgtttttgaaaatgtgtgataaagtttcagtgactagagcttttagcgtcttgtaacattcacctcaacagttgagcacttactcatgatcagtgaaaaggtgaacattgaaattatagagataacaaataagccaggggaaaagtaagagcaactttttctgcatagacaataaagaatgtaggttattacctgggaagtctgtttaatatgtaataagatttgtgtgagatgatgagaaaaggctctaacatgagttgatcttgagcccaatgttgaacagctccagaccttacaatttaaaaaagtagttcagaccgggtgtctgagttccgcagtatacctggtccagtggacacttgcagaatgccgttggcacatgccactggccattgaggggtccccagatgcataaacagcctgatcctgtagctccccttccccacacggatgcatggaggcaggtggcgaactctaaagcctcactgaaaggcagattgctggactgttagaaggggctcactcacctgcctccaagcgcttgtcttctgtttacataagaattacatctcagcaaagttgaaactatcacacaggatagatgctcagggttgcttgagaatagtcaaaactgagtattaacttcataagtgccaaagacttcaactgcatatatttaaaaaatccagaggagtatgttatggtgagttattttgtaaaatgataattgtccctgttaatttaaatttttccctttgggatttgcttaaagtagggctgtgcctgtatatggaaagggacaaaattggcctttggttttgggcttaattttttattccccaaagactacttgaaaagggttaagatttctgtttttcttcctctctgtaaaggctacagctatgagcgtgtggatggttctgtgagaggagaagagagacacttggccattaagaactttggacagcagcccattttcgtttttctcctgagtactagggcaggtaggctgcaaaggcattgatggaaacagacaaatgagggataatagagtactattacatcccaacggttagtacacttttttccttaattctctgaaaggtgaggttactattgaatgtaaaacaaggtactggacatcaagcatggtgctgttttctatccagcctgtccaaactgtcatctcagcaaagaagtaaggctgaaacctggggttattggaaagtaattctaatctgctttgaccattgacctgggaatgtcctgaaagatttatgtgattttgtggaatgtttcatttacattcagtggaagtagctcttcttcccaaccgtgaatttgggaaataaggtaacagtttgtctactagttgtccttcctctataagtatttctggaatagtgctgaaaagcttaacaaaaatctagttgttaaaaaatgtgattatgttgaaaataccaactttttagaattatttatgacatcatccatatatgatttaaatcgtgaatattacgacatttgtaatgctttaccagttacagagtgctttcatttactgttacataatttgaaatcagctcttggagatgaaatgattctctaagtcattgtggtgtctggaaaaaaaaaaaaaaaaaggccggcacggtggcccatgcctgtaatcccagcactttgggaggctgaggtgggtggatcactggaggtgaggagtttgagaccagcctggccaacatggtgaaaccccgtctctacttaaaaaaatacaaaacttagctggatgtagtggtgcgtgcctgtaatcccaactactacggaggctgaggcaggagaaccgctggaatccaggaggcggaggttgcagtgagccaagattgcaccactgcattccagcctaagaaatttttctcaggtcctggagcaagctgaccttagttttcaactcataggatcctagtttcattatcttatttttgtagacataaatcttgatggagtacatgcaggaacatgaaagagatgtgtgtcctctattaaagacagattgacatttttctaaaaagagagttcagtcttatttagaaagctttctaaatgcctgctgctataagggtatatgaaagaagtgttagatataatttttgattataaggagattatttcacctgtgtttgttttatctccctaataaaattaataacataagattcatttggcctcactcttccaagatcatagactgcacatggagtctcagccattttctcatgtgatcagttgcctcagggttagtctcaggagaaactgaaagaatcaggcagtgcatcatcactgccgggaaaacagttttatttatgctttaatgatttcatcatcctcatattcagagagcagcattatgtttgaaatgtctaaaattaggaaaaaagagatctctgcttttcagttaatctccttggaggactcagagtagatctgggagctgaagcagtcctggacattagtcttctccaaacactgttgtgtttgctgtcacagttttgttgtagttttgcagtattttcatttatttaacaggtttccttccaaatttcaaatatttctgtgatgagtcatgttgccaccagatggcagtgatagctcatgaatatgttcctattcatggatgtgggtgtggcttatttataaaaatctcacccctcggtgaagagctgcacttagacaacatgaattcaagaagataattttatggaacacattttaaaatgaaataagcacctgaaaagtattatagtatagtggataaaagcacgggctctggaccaagactgcaagggaatgaatcctggctctttcaccttctaggcttgcaacttcagagaagtcccttaccctccctttcaacatctataaagtggggaaaatcgtagcaactactcaacttcccgacagggttgttgtgagggttaaaggagttaatatagagagagtgcttagaataatgcctggcaagtagtaagcacagcgtaagtgtcattatcattattattaggtataatttagcatctctcagtaatcggtcatgattacctccttgttccaacttcaacttgatacgaagactttaattagaatattcctgcctgatttgtctggagatccagcttatggtcagtagtccttcttaaaagttagtccttaattcaggtttatggaacaagccctttcaggcttgcttgtttcagcaaccagctctaacgaccctggcaagagggagtctgttttgtacttgttttcacattaatcaaagagaaggctgcaatgtaccttcacggttctcttaattaattcctgtaactcaaggtacctcctcagctctcttcctgcagcactgaagaaagaccagcaagagtgttctgagcaagcctcagaacactcagagtaaatgacaagagtgttcttgtcttgccgttggttttgttactttctttttgattaatgtggaaaccagtacaaaaaagactcactggagttttctctaatcagagggaggaggtttcccactctgctcaggagtataatatcatccactcttctcattaactttttatcagagatcttgctacctagttgtaacttgcaagcgacattcggcactcttctcttgacagtgcgcattgcagacctctcatatttagatctgttttctgaaagagcatgtgtccttttcctcagactactctaatcaaaatctaatcaaggtttttaagcagaagagataaagtggctccatggcactgacttaagtatccaccttggccacttgcccctgctccgctcattctgttccattcagtaataaaaattttcccatcaggcaataagaggtcaggtagcacttctcaccgctggaacaaggctttggagttaggggtgtgggtccatttgaaggatgaagccaattgttttgactgatttcagtttatcagtctgacccactctagccttgtgcttattttctagctcctcgtctttgtgctgctgattacattcctttttgcattgttttcaggtggagttggcatgaacttaacagcagcagatactgtgatttttgttgacagtgactttaatcctcagaatgacttgcaagcagctgccagggctcatcgcattggccaaaacaagtaagtgatttttttctgctttcttggcttgcccagcagcagttctgggttgtgaaaaaggtgaagaatatagtcctggtgacagtcccacactgggagccgagagaccaccaggttttagctcatctgtgctattgactcctagggtagtattgggtgggtcacattatcagtccagactgactttattagaaggagtcaaatcaaactgtgaaaggattagaaggaaactttagaagtcatttaactcatccttcttgagttagggtctgactcagttaaaaaatggggttatggggctatggagctaagctaaaaaaaaaaaaaaaaaaagatagatgttgccctttgatctgaggataatttgatcttccagatattttccttggctacagataaggaatcccagtcatggttaccccatcattctttctttgactgtctggaatggttcagagagaatttcaggcgagttctctctaacaagtgctcaggaccaaatgaaccaatctccctttcattgtaccctgaatatggtatttggttttgtttgcttttagatgtatttaccttgcatacttttgcccagctttgcacacccttatagcacactacccttgtttgacttatgtccaggtctgttaaagttattcggctgattggtcgagacactgtggaagaaatagtctataggaaagcagcctccaaactgcagctcaccaacatgatcatagaaggaggccattttactctgggagcccagaaacccgctgccgatgctgacctccaggtatgatatgatatactgttcttcactttggaatataccaataccctttgtggaggagaatgtaaatgaaaagaaccagcactcaccagccactctccccagctacacatttgttccttggcctccctcacacctgccacagtgctggctatgtgcagggtctgtaggaagtaaggattagttccaagcctcatcacttcttggctgtttgggtttgagcggctttcttaacttcttagatctactctttttgcatttctaaaaataaagacaccacaggttagctcagagggctgttaagagaattagttaaaataaagaactcaataacaattaattctgtacttccaccttagtcccagagcctttgatcagtgacttacattacttcatactcagaagagggcgaatgagatcaggaattcataattgtgccttagaaaaaatgggtgaaagaactagaggtaatttatttaaagaagggagtactggatgggagacagacactggattggaagattttagagctctcttttggaagaggacttagagttactctgtagcagcccttgggttaaaattaaaactcataatatttcctggatgctttgtttttgccctaaggatgaggggctggatgcaaagagaccaactcctaggatactagaaagatgcaggtatgaagggagtaataaatgtctgtcaagggcagcatcagtgggagagtctggtgtgagaaacattgcaaaagaaggaaggacaggagttggctactgtttagagttgggtctcaacagtagggagatagaaaattcaaagatggctgtgaggttttaggcccctatgatgaggagagaagaaaggaaaataagaagtagggcagagttttaggaagataaagagaatttaggctttagtcagagtgtgcagtaaaaatacaatataaacaaactattgttagaggcagactcagacaaaaggaaagaattttatttgtaaaagtttgcaagatggactaggattggaaaggactagtccatcaaaaaacataagtgtttaagagagaaaaagtgacacaatattagaagcagagttactaagtttgtaattagtctgaaaaaacagcagttttcttacatggttactgtatctgcaaaggccagtgcatatctttacatatcagtgttgcaaaagacagggatcctgttgtttttgttagggagttagtaattacaggaaaggctcaaggttttattaattttgggactagaactagaaagagtaacactgggtttgttctttgtttatcttagggggtaggtgtggcttttttctttttctgactttccttgtgttgctgactgtgtcacatgcatgcttaattaaccataatggtgctagggcaggctgtacattttgttttcacactaagagacaattataaatgtgagatgaaagcttgagagagaggtagaggtacgctgtagatacccttaaatgcagttttccacagaaaaattatccatagaaccttaagagagagaaggtcactgctgggcatagtgaaggggtaaatgacagagcctcacaaggcccgcattctcttgttagaggaggaaggatgtcataggttgtttgcactctcccagtggagggagcgccaggggtccaatgaggggtatcttgtgatgtgggctgctggacacatcactgtgaaagatgtagacatacctccaccccatggggccacaaacgagtgggaacatggactgctggctgagagcgactctgttggacttcttgcccagctcatggttatcggaaagttactttctgactctaatgtctgatttatctcttccccatgcagatgctatgagttatttgtggttgccaaaagcaaaggtgataacccagagcccttgtctaaaaagaaagcaggggatttttgtttgtttttgttttttgggttttttttttttttttttttttttgagacagagtctcgttctgttgccaggctggagtgcagtggcgcgatctcagctcactgcaacctctgcctcccgggttcaagcaattctcctgcctcagcctcctgagtagctgggactacaggcgcgcaccaccacgcctagctaatttttgcatttttagtagagacggggtttcaccatgttggccagaatggtcttgatctcctgaccttgtgatccgtccacctcggcctcctaaagtgctgggattacaggcatgagccactgcgcctgggggatttttttttttttttaaataccaagaaaccaaaagtaaaagatgtggttctgatttggtaaatctaagcagtaggtatggagttctgaagtcctgaaagaaggaaacaggttttttatcctgcagggaggacacagtagaaacaggcaggcagatgcaggtgtagtgaacacttattggatactgtgtgctgagtgttgtctgaggtgctcttttccagttgtttcagtaaataagaataacagcaggatgagatagacactatctttatccccatcttaagtaatttgcccaaggttattcagatttaggattccaatccaagcactctctaacctccgagcacatgcccttaattactgtaatatacagcttctcataaaaacacatgtaattttcttaatgactaagacacattgcaagtgagcaataacaagggagagccaggaggtgagcataagtacaagggggtgaaagggagggtcccagtatggaccaattcttatcataaatagttggcttcctactattcttggtaccagctgccaaagccagtcatcctggttatgtgtatggagggtaaatataatatatctaggtacattcatgcttaagtgagctgtctattgtttcttcaagctgttacagaataccttaacatttccaagttactcacaaaatagacgatctggagataacccagtctaaaagggcaagatgagaacaagggcccaaggtttgaatccaccttgggtcaggatctcagaattagtgcttacggaggtgcaaagttggaagtagcaagtgaaagccaggaaaaattatctgtgctttctgcatggttcctacagccatagggaataggctgagagtactccagagagggacgagagaagagaagcaggatagtgcaatgccagaggaacatccagaaaaattcaaactgagaaaaggccttcgggtctggtggtcagaagttgttactgatctttgccaaggtggtttcgatagaccactgtgttaggaaaacaaattgccaaagaaaaggagtcagttcatgatagaggtaaagttcctagtgtagccttccctttctaaggagtctggcagtggagaggttggaaagtagctaacagggtctctgatctcaagtggctgctgggaatgcttatgaaaaagtcagtgagaggtgctgtagaaaatgcaggaagttactattattcttcaaaaaaattggaggcttatacattttttttgttttgtttttatgcagaattgtcaaagtcaatacctctgataatcatttatcacctctctgcttacccatcatccaactattaaatggccctggctgttactatctatgatggggagagcagaaaggctgcctgttcattagagaaggactgtgcctggtgtcgttaatccacttagccaatcactgatatcctaatgtttcttttcatgagaatttgctggacttttttgtttcctctattcaagttgagtgagatactcaaatttggtttggataaactgctggcctctgaggggagcaccatggatgaaatagacctggagtccatactgggagaaacaaaagatggccagtgggtctctgatgccttgcctgcagcagaaggagggagcagagatcaagaggaaggaagtaagttggaggttagagcagagcaaatggcacaaccaccccaagctagagctcacgtccccatggaaagttttggatgctgctctctggggcatcttttttctcccttaccctattgtcatttgggcacactgtttaagacttgcttgataaaagaacgttacccaaactaactggaaatttgtgtggctcttcccttgtagctgaactgtgaaccaaaatcatagtattaatgtttatgatagtatcaatcttaaggctttgaatttgtaccttttctcccttggttgcaaacatcttcttctttattagtaaagcctaccatccttggtatgatgctttgcacatagcgattcctcttctaaacagtagaattacttgtttttaaaattgcagctaacattaagcatttattttgcgttcatcaacagtgcggactttgtcatgtgctttttccatttaatttctgtaatccatgagatgtaggagatggttttgtctttctcttaattttctttcctgaatttggtcagcatttgtcattttgttcttttctattctgagcacttaaatttccgatttgaagtaatttttcacatggtagctttgtaaaggtattccctggcatcttgtagttattttgaaatgacttatttttctgtaccagctgcagcagagattcaatatggactggggtgagaggtttgggagtcttactaggcttcttaattcaccagtactttcttttaattatacacaatagtgctgtttcttcactagatggtagctcctttttattttgggtagtggtagtggcatgatttctgcttttgtagttctcttttgtttctataggaccgtgaatttccatcgctcgctttctctctgtgccacaaacttgtcaaaggatgtcttcccacttctaagttgtctctctccctgccagaagcaatgccttccctaattcctggctgcatgtattttcataccttcccttctgttcagttccttagtagccactgctctgatccactcagacctatcctcattattttcccacttggaatgggactgtcttttgtgggtaacttttatctgtctgacctttctggaaccctcctgccctctccactgcatagtctctgcctgactgtctactctagtgtgggctttggagctggttttgggggttcatttctcttaacttccataagttgaagtgtgtagtattttctgactcctaatgtagtaggcatggattggggtggttttgttgtccttgttgatctgtatagtttttgtgggataggtggaaaagttggaatttgggcagctggcattgttttacaggaaactgctttttgattttatgttttatcttcgaaattctttataaaaatatcttgtttgtattcttcaagaactctttcttgttctctgcttattgttttaattgtaactctgttctcatttcaaggacatactgtcttctctggggacatttattatggctttttaatatgtattccagggagaatattacatctttttaaaaagtatttctcttcccattgcattgacttttacttctacttctttaaaaaaaaatatatatatttatttatttattgaaattggcagataaaattgtatttatcatgtacaacatgatttcttgaagcacatgtacattgtggaatcattaaatctagctaatgaacatacatcacttcatatggttatatatttgtggtgagaacacttaacgtccactctcctagtatttctcaggaatacaatatgtcatcattagctatagtcaccatggtacctctttttctaaaaaggaaaattcgtttggggatctcttgttctcatcgatagtttccccaaccgtctggtattccctggctgtctgatcacatgtgctgatgaagtgccacaaagctgagggcagctctggcatgggccctggggacttattcctggttggtgagtcagcttttacatggagggcaccttctctgatccatatttgatgtcttttcactgggcaacccattttctccagagaccaatcttctagtattttccctgggagaggtgagaatggagttcacctggttgctgaaactgaaaaggcggggtgagtcaagggctcatggcactcctgctctttggggtgcagatcttctctcaattcccccctttgcagtactctgtacttgtaagtcctaaactcttgggggattgagagggtctctagactcctaatgagcccttggctaggcacctgtgttttgtttccatgtctcttcttaatctgtcattatccctccagcaactttgcattttccaaaaggttcttgaactttttcatccaccattgcctcatagatcttttttaaaattcctttaactgtcactttgtggtttcaagtgagagaagaaatagatgcatgtgatcatatttttaagttataattgattatattaagtagcaacacactcagttctgtactgatctagataatttcagcttattttcctaacgtttactagaacaaaataaagtcacactcttttccagaaagataattatatttctcagtcaatccaactgcctaaaataattttactttatttagacagtccaactgccagaaaaaatccccagttgtattacactttggaattttctcttcgatgaatggatataggtccgctctgtggtaaatgattctcctggtaggatagagacgcgggtctaggcttgtgatggcagagtgaagataggaagtatgattacaaagaatataagtggataggaaagactagtaactaacgtggccccaatcagaattaaataaaaaacagggttgctttatcttaaatgccagcatttttttaaaaagcatgtttggaagttgagaattgcatgcagtatgaagctacatatgttgatcatatttgacacttctcagctctatttttttctacttgttgatagagtgcctcattgaaagccccctgctgatttaattagcaaatgccaattagaattacagctggttagatttgggtacaagtgtgaagcaattgatctcttgagaatgaaaatgttttgctttcatactctctagggaaaacatacttataatggatttcacaaatattgtgaaaatatattatttggtaacatgtgctactaaatatgcttcccgattcaatcattatcttacctatctgtggttgctagtcttggctggtcctgacttttcttaatcacttgattcatgatcttggcagatcactcaacctcattgagcctttttgttctcatctgtaaaatggtcctattaatgcctactttactcttttacacagttggaaaaatcagacacgattatagttgtgaaagtgatctgatagcatgaagtgctattcaagatgacactattgtcttcattgttattattaccacagttattatttgctagcctgttaatctctccacccttctagagacccaattatatactgaaaagagcacactggccttagaatcagaaaatcctgcctcttccagtgagaattacagagtcccttaatttctgcctaagcctcagttttccctttcaaaagtaggattagttataccaggattgtggtgaggatcatgacaaagacgcttgatgagatctgtaaagaatattgtaaatccaagggattatttttgtgattcttcattttctcatagatttgccaagctgaatattaaaagtgtgtttggaataaaaaagtacggattttattagatgatcttaatgtcagtgagatttgcgctgagggatagttgggaataaatgaatgaggaatgaatggaagaatccagcagagattcacaaaccatctagggatgaaccaaagggttttaagccatgctctccccttggaaaagtaaacacatgggatccccatgtagaacccacattcttcagtgtcagtgggatgggaaatgaaataccttccttcatatggacttagcccatttagaatataggctgttctcctgtccacttttgttattgatttgaatagcattaatctatttttccttggtatctaacatttctctctttgtgttttatgttgttagaaaatcatatgtacttatttgaaggtaaagattattctaaagagcccagtaaggaagacagaaaatcatttgaacaactggtaaaccttcagaaaacccttttggagaaagctagtcaagagggccgatcactccgaaataaaggcagtgtaagaactgttaatttatttaaaagttgttcttccaaactctcattctaaaacaaacaaacaaaaaaatgatgctggcatcgttttgttctcttaggatgatttgtcaagaaataagtatgtgtttgctgaaatgttattataattaactataccctagtataaaaactatgtaaaaaagtcagcatgaaaaacataaaggagagaatatattgtacgatgtcatgcaggtgaaagcagccttgtccatccaagtcacccctaaaggcattcctatattataccaaaataccatatcctgctgttggtaatgatgaccctatgacaagaagagaggatggcaatcataaatgatatatgtagtgttcacagtgtttggcagttaacgtggtcattaaatgctagctatcactaagataatcatgatgttgaaatacaatcttaaaaaagttacataatacattgcagaaagagttccattaaaaatggctgaagtggcatcctgcagggtatgcttttagtcaaggaaaaaagttacttttctgaagtaacttattcctaatgaaatgaatcaaaatgactgtttcaaccatgccaatgctagggctgagtttacagcatggtatcctggtcactgtgcctgtgaagtgtgtagtatgaacagtgcctccaagtgctttgcctccagttcccaccatgcagggtgtgtggagatgcagtgttctgtggaatattaagcatgttgcttccgtacagtgtgtgttagggataatgaaattcggggaggaatcttcttgaccctggtgatggatcttgttcttcctctaggttctcatcccaggccttgtggagggatctaccaaaaggaagcgggttctgagtccagaagagctggaggacagacagaagaaaagacaagaagcagctgccaagagaaggagactcatagaggagaagaagaggcaaaaggaagaggctgaacataagaaaaagtatgtctgcgttaaccaagctggcggccacagttgaaggagtcactattgtatagtgagaccacagttgaatatcactttaaaaatacagaaaattcattttaagttggttcctattggtaacagaatactttctgaaaacatttcctctaggtaagtgaaaagtctcagtgtataaggcagggaagatgcattccattaaaaccagaattgttttcttttttcttttgagatgggttcttgctctgttacccaggctggagtacagtggtatgggcacagctcattcagcctcaacttcccatgctcagtgatctacccactataacctccctagtagctgggaacacaggtgtgtgccaccatgcctggctaattttttttattatttgtagagacagagtttcacggtgttgcctaggctggtctcaagatcctaggcccaagctgtctttctgccttgacctccaaagtgctgggattacaggcgtgagctaccatgcccggccaaaaccagaagattttaagattttattgtagctatctgacaaagagtaatttacttcaacaatctcttttagtcttaaaaacaggaacattcagggagtgctcattattgaattgtagtcaggaagcagttagcctaatcagtaagacttgtttacaaataagtagaaaacttcaatcagggtgagtttctaattgcatttctacttggcagatattgtttgtgaacagcagtataaaatgtgctccaagggaaattgtgattgtctgggttaatttccttttgtctctggcctgctaaaggatggcctggtgggaatccaacaattaccagtccttctgcctgccctctgaggagagcgagccagaggaccttgagaatggggaagagagctctgctgagctggattaccaagacccagatgctacttccctcaagtacgttagtggtgatgtcacccaccctcaggctggggccgaggatgctctcattgtgcactgcgtaggtacgagaagtggtatgggctggggatgggggcctcagtccttatggtgccaagaactggggaggatggggcactgggactggggtggtggtcccagtgtagtattgtacagtcaaaaaagtgtgaattttagagtcaggagatattccagaatcatttcactcttggctttctcatttacctggtttagttacccaacctttcaacttcaacttccttatccatatgatgggacaatatctgtcttatcctctgcacaaggtttttaagagggtgaaatgaagcaacattgataagacaaacaaatcctttgagaaaaagcaaaacttcaagcttgttcccttgcttgacctttgtactttttacttcatctgcctaaaaccctttcttcccaaataaccacatcaagtgttgttcaaatgtctgtttctcagagaggtcttctgtgattacctcatataaaacaggccccatcccccctctgttattctctgtcccttctcccatattttcctttatcacacctgtcccacctgacacattacctatgtatttgtttatttgactgttgctttgcattaaaaaatacacttatggcagcaggggttttttcttgttcgctgctgtgactgtggtgcctagaacgatgccttacgtgtaatacatgctaccaaacgtttgtagtgtgaatgaatgactataaatgctaagatactaagcagctttgttagtaccagcttgaataagtcacttaacctttcctgtgtactgtttcataaccttgcctatgtgctgttgcataacctattgcttctactcactctgtaatgttccatctactctccgtccttccgcagtcatttgccaggaatcacagatgcaccacagagattttgctcattgagaaccctaatttttgagatgctttcctgttatcatggccccagctatatcttccagaaaacataaacatatttgggaagtccaacctgtgatattcctaggagataagatattttgtttcttccctttgaaaaatcattcttccacaagtcccttttgtgtgcctttgtttttctaaattgtgcactggacttcacctcctatagatgaaaattttctctttcttcaaacagatgactctggccactggggcagaggtggtttatttacagctctggaaaagcgatccgctgagccaagaaaaatatatgagctggctgggaaaatgaaaggtaagaagcaaagcagagggaaaggttaagggtggaataagagagaagaggacacctaagactgtatcgtgagggttacacagcactagataaggaattagaataaccagttgggaactgaattctgtcataaattagctacttgttctgtgacttcaaggcattcctttaccttttctgtacctgtttcctcatctgtgatttgtgaataatacttgttctgcctacttcatagaactgtagtaagcataataaatgtgtgtattctgaaaaatgttgatccctgcatacatgttaaagtattggaatgggctggacacagtggcccatgcctgtaatcccagactttgggaggctgaggcaggaggattgcttgaggccaggagtttgagaccagcttgggcaacatagtgagatcctgtctctaccaaaaatttaaaaattggctggatgtggtggtgcatgcccgtagttccagctactcaggaggctgaggtgggaggatcacttgagtctaagaggttgaggttgcagtgagctgtgattacaccactgtactacagcctgagtgagagtgagaccctgtttcataaaaaaaaaaaaaaaagaaagaaagaaaaaagagaactattggaataaacatgaaggaatatgtcatgaaaatatcaaagatctatgggaagccgggcgtggtggctcacagctgtgatcccagcaatttggaaggccgagacgaggcaaggaattcaaaaccagcctcaccaatatggcaaagccctgtctctacaaaaaaatacaaaattagccaggcatggtggcacatgcctgtaatcccagctactcaggaggctgaggcagaagaatcacttgaacctgggaggtggaggttgcaatgagctgagatcatgccattgcacttcagcctgggtgactgagcaagactgtctcaagaaaaagacctatgggagagaaattggacataccattaaaatgctgacaagaactcgggtttggtgctgagtggaatgaagatgtgttaagaggtcagcacaaccttgggtataacactccctggagacagaaataaagctgttgggtgccaggggaacttagaagcctgaacaatattgtcctttggcacagagaagggaaaaaggcacctccttttacatccagaaataacaaagtggcaagaataaaattattattgtggtgattttctggagattgaaggaccttgtctgatagagaagggccctccagattccttagatattgttttttcctaattctgcccagttctctatggtggaaagggatataagaacttagaatgactactttttctagtaaaacaagttactgaaagaagggtttaatgtgtgttgaaatagtcaatccagatctagatgctgattgggcagttggcaaagcaaaacccagggaaggtcagagctggaggtgcagattgaggagtccctgtttggagtctgtgtttaaaatcatgtgggagagaggatggagaaatgagaggcagagaacagacctggaaaacacctctacttaggacttgaggcaagaagatggaatttctgacagaaggaattgtcagacaattagggaaccttgtgcggtattttgaggtacaagggaggaaagtatgtcaagaaggcaaagaagttcatggtattagacactgaagtgaggatgaattgggaaaaggccatggattttgacccaaggttgctcaccttggagcactttgaggagagtgggaagctcagacttaaggcctgagggctcaggaaggaaatggagatgagagtgtgctgttttctctgaaggaggattgaagcaggttgcagcaaagtaggtgaaactgtggattccaattcccagggaaggcttcatggaggtcctgggcctggaaaggtgggttgaatttgaataggtggagagaaatggcaagaggatccccaactgctcattacaacacttactattccttgtctgtgggtattgaaggacccaggcagttagcctgttcctttgtgtggaggatggcgtacaggccatgcaggccagagtggagggtttaggcagaagaatagaggagagtttcgttttcatcagcggcttgggccacatcatagaagacctcacatgatttgtccagggagatgccattctgagcagaaccttatctaatggaatgggtaatagctggtcgttttgggggatttgatcaaaaggatggcatagcacaaccagtattttagaatgactgaacaaaaagttcaaactggtatcaacctaaccagtagacagggtctgtaaaataaaaggaacaaaggttttttgttgttttgtttttgtttttgagatggagtctcattgtctggagtgcagtggcccgatcttggctcactgcaatatccacctcccaggctcaggagatcctcctgcctcagcctcccaagtagctttgtaccacaggcgcacaccaccatgcccggccactcttttgaatttttggtagagacagggttttgccatgttgcccaggctggcctcaaactcctgagctcaagtggtccacctccctcagcttctccaagtgcaaggattacacacataagccactgcacccaacctgaggtttttaaggagaaatgaggaagattacatactttttttgaatcagttatccttggctacaaggattagtaagggtggcaccacgccgaggttgggcaggcagttgatgagcagatgtctttgcagaagtatatttttatgtaagcttgccagggcccttgtgcaaggtcatgggttttgtaaaatctgttgtgatagttcttgttatcagacatttatgcattagaaccttcccttcatggccttccctggctctatttgtcagagttttgttttattttttgagatagggtctcaccctgtcacccaggctggagtgcactggcgtgatcatagctcaccacagcctcgaactcctttgctcaagagatcctcccacctcagcctcccaagtagctaagactacaggttcacaacaccaaacctaactttttcttattttttgtagagactgggtcttgcgccttgttgcccaggttagtctggaactctggcttccagcaatcctcccacctcagcctcccaaagcactgggattatagtcatgagtcactgtgctcggccgtatatgtcagtttttaacacaagcatctctattttgattctaaccgctttcacatcagcttatgtaaagccatagaattaaattagcacatttttcttcactatcagttttacttgatttggatggggtaggaaaatatattatacaaacaggtagagataaagtagaatgtaataatttgaatgatttaggacaagcacaaaactaccaaaggaatttcaagctcataatgctccctccccaaagccccccagctacctctgggttttgtattcactttctgatgtctacaggggtactttgttgttaatgtttgaggagcattaaattaggagatcataaaaattcaggagtgaagcaggtgagtacccagctaagaggttgactgaggccaggaaagtgagaaagggctgtgtaggaaggtgggtcctgaaacccaactgaatttgaagagggcgagatacgaggaggattcattcattagtgaacttggtgttctttatgttgctcctttctgttttacctcagacctgagtttgggaggtgtccttttatttcctgttgatgataaagaatcaagaaacaaagggcaagatttggtaagtaaaacccatctcttctcagaactacaagtggactcacatcaacttctcttgaagtgtcccctgccccaattggcctctctgctagtgtattagtttgttagggctgccataacaaaaagacacagactaggtagcttaaacaacagaaatgtatttccttatagttctggaggctgaaagtccaagatcaaggtatcagcaggtttggtttctcccgaggattctctccttggcttgcagatggcggtcatcttgctgtgcatgcacaaccctggtgtctgtgtgtccaggtttcctttcttgtaaggatagcactcagaatggatcaggccccaccctaaacccttgttttaacttcattgcccctttaaagactctgtctctaaatacagtaaacatgaggtacggggggttggggcttcaatatatgaatttggggggacacagttcagcctataacaagcagattgggccatagtctccactgtacttcccctgtccccaggcttccatccatctgtccccggagcaccgtccagatagcagatcccatcttaagtacgaggatttctatttgtctttttatcctcagtaccctacatagtactagctcataagaaatgctccataaacatttactgcatgagtaagaaagcatgactcagaactctgacggtttcatttcttaccatgtgaaaatttctatgaaagattgtgttttctagtcagccataataaagcaggagagaggaactaacacatatgtcctctgcccacatcagaatccttttgcatcttaggcatcttgggatgcctgcagtgagtttgattaaccccacctacctggctttctccaaggcctgggttcatgttcagattttaagccagaattaagaaatttcaaaatcaggccaaaagagaggttcatccttttgaggttgctgtctatgtgactgtgttaggctgtttttgcactgtgataaaagaattccctgagactgggtaatttacaaagaaaagagatttatttgctcatggttctgcatgctgtacaggaagcctgatactgacatctgctcctgctgggggcttcaggaagctcacagtcatggtggaaggcaaaggggaagctagtttatcacacatggcaagagcaggaacaagagagagtgggggaaggtgccacactgctttaaataacgagatgtcatgtgaactaccagagcaagaactcatcaccaagggtatggcattaagccatccatgagggatccaccccatgatccaatacctcccactaggccccacctccaacactggggattacatcctaacatgagatttggagggggacacacatccaaactacacagtgactaacagcaaagtggtttctgttgagtcattccttcagtaatttctaaaatgctaaaaaaggagaaaagtaaagtgtctgtgcatgagaaactcagaatccagtgattcaggaaaactgtttacagggagtagagcaccatgtctatgatatgactgtggtgatgtcatcccggaagctcccttgacactctccagctctgcccacttaggttaggatggttgagagatacttggcattttgtcctcatgggaattgttcgaacagagatggaatgactgcttgtcctgggggttgtggagctgactcaggcatcaaagggctgggatacaggagcctctaagatcttttccatgcctacaattcagaaaaattctcttttttttttttaacccttgagagcttttggaaagtatatgttttggactcattctctggttttaaagtattttaaaaagaagaagaaaaccctgtataaagtgaccacaaagtaagaattatgacgggatgtgaagtcatacatatagtaggacattgctgttcaggcatagcatccgaaagagacagagccaagcccaagtgacccatcaagggctgtgccgcctccatgggcggtcacttggttgagtgtggctgtttcatgttgggttggtcatctaatggtggttctttccagttggccttgattgtggctcagcatcgtgatcgttccaatgtcctgtctggcattaagatggcagccctagaagagggcctgaagaagatatttttagcagcaaaaaagaagaaaggtaagctcttccacctgtgctcaagagtagatgaatttgtttctaggcatgtgatacgacttttgaagggaggtaagaaatgtcaagatcccacttaatatgcacggtaaaggcaaaccacagaagtgatcaccccaccgtcttgtagtcatatagccccttgtcctttccaaaacacttttaataccggttatctctgtaggccgtctccatcccccgggtatttttatcgtgattttacagatgaggtggcagaggactagacatgaagcaacttggtcatatgtagttggtaaatgctgtttatttaatctcctcttggagagtcacagttcccaataacagacagttcttcgacaaaaattgagtttagttttgtttcgaaacctagtgtgtctcagagcttattgaattgattggcttgttagagaatctttgcttattttaattttgcctccaccaatcataatctatttccaattgtatgtatttccagaacttgtaggtccttgtgttcaacagaataatttaatttttcttactacaattcttcccccggaatatttttgacattataattatgggctttgagggagatagtcaataataattttctcccatgtgtattttatacccatcaatcaatttttgatgagtgaagacgtgttcttctcttcataatagcaagtgttcatcttccacgtattggacatgccacgaaaggttttaactggtatggtactgagcgacttattcggaaacatctggctgcaagaggcatcccaacttacatgtatccttttgtgatcttcattgtgtgttctcccaacccaagagggaaaatgtgttcattttctggtgtcagttcttaatccaagaccaagtttcttcctgccacagtctttactttccccctcttcagtgagacaaagaaagaagcactttctaacttgtgtgtatcaaatatgtacacccaacaggatcaacacatccaagcatttctggatgccagcagataaattaaaagatacatgaaggggagaattaattgagcaattgttaatttggtaacatattgagtctgtcacatcacttctctagagatccttcaggtctgtggaacaaggcttaattctaagaacttcacactgttcattttaatgaacagttaagcaaacaaataagtgaactattttattcctgaacctttttgatgtattgttaaaaagcagtatgaaatttattttaaccatgaagtcatgatctactttagctagactagcgttttcttctaatgacctccttgcttataagttagcatattttgaactattatattgagtcccaaaattactagagaaagcagaattgaccccaagtgctataatcacacagaaactccatctttttacatatttgactgaaattcactcagtgatggtcttcaagatatttaaatcactgtaaaaacttagagaagccagcttttatgtgcttgcacaattcgagcagtatctaaagagttttagtactctgaaaacaacagcagcaataagtactaatattgaaagtgtttatgatatcgtgagagaattaaagcatactacttctagaacagttatttcaataattactagagaactagtcgttttggtaaagttggtttaaagtgatgacatgtatcttccttgaccatccttatcagatattattttcctagaagcaagtctgctgtccttcatgcacagtcttcatcttcctcctcaagacagctggtgccttaagaattggcccagcctcagatcctgtctttagcaaccagctaatatttacccagaggtactgcaatagagtatttcaaaatggaatcaggatctggtgggcctcagaaattgtctcttttctgagtttcaatttggttctcctggatgttttgctctgttttggtacctgtaatatagggaaacacaactttttttgggaaagccctttgaccccagcttgctagttgcataataataaattttctgttcctaatggttttattgctttctttcccttacatctagttttcttctcttctgccacactgattactttatagagggaaagcctgtatggattaaggagacatgaaaggtcataaaacagggtggctctgggagaaggaagcaccttcagccagttcatgccttcaaaaagaaaggacccaggaagagacactgagaagtgagattctttatccagacaaatagtgtacctcctctcctttttgcactgcacaacatcaagatctggaaaaaaatacattgatctagagtttgtcaaatgtgacttcagaaaaaccacaggatcttttttcttctagccaccaaatccaattcagcttcaaggaataagggaattgtgaaaagggcgcaatcccatcacagcatgactgatgatactggggagggtaggagaccgagaaccaacagagaaggagtcatggagggaagactataagtcgtggctttccacacctgtgtgtgtctcagtcttggctgagtattctcacccagcataatttctgctgacttgaggccatcaacacctagagtgctatggaggcctcatgagaagtctcagtcctgggctttgatgtggggaactctggctattggactcagagccaggaccatggtcttctaaggaaggttgtacctgtgttttactgttctgagtctcttctcacatattcacccttcattaatatagcatcatgctgaagacctatttcatcaaaaattcagcattccttaaattttttttcccaaaacttgcatcgattttaactgcctcctatccactactcttcccaccacccttaacatgtaggttattataccaactttaacttactgatttgtatcttaagtcttgcctacaactggaagcaaaattagaactccacaaagggagaatgtagtgaaacctaacctaatgcacgagtaagctgctgtgcctttcagaagcagtcagggtgcaaacaggtggagtattaggaaatacaaagaaaacttgactgggcaccatgcaaaagctgtagatcctcttggaaagctgtgctcatttctgagggcagaacacatagggctagctggggatgtttttgaacatccaagagaagcatcacagcaggcaacttgcttctaaagggaacgtcgctgacctttcagggacagttgtcttttgtggggagaaagccttcttttttccccctattctgtcaaccatggtccagtcgtgggatttttctctggatgtagtccctgaaccatgaaccttggtcttgtaagctggacataaagagtacagatgaagatcagaaaacacatgtagcacattctcccttaaatgtggggtcacttctcagtggcaatgccctgatttgcttgcgcacctctcttaactcttgagtcgaaaacactgccctactacgtattcagaaatctgccctatcttttatagtcccttcgttctttctatcaaagaggaatcattctctgggaaagtagaatgagacaggctattctatttaccccaagggattgttctctttcttccacaccatatctttgatgctatctcgctgtcccctctgaggatggagccaggaggatgataccagattttattcactgatgagctcttgtagactaaacatcagcttttgtgcatcctaaccatcagcataaaaatcccacttattgagaccatgaggaccttaagtctatggaaatttttctaagtataggctcatattttcttgacttttaatacatttttcttacaacaagcctacaacttcttttatttttttgccccataaaactatactaagttaattaaccctttaaaaatatagcttgagtcagccatttttgagccctaaactatttctacatctgtattttctgttttcccgtctactgactgaagtacagttgtccctcagtatccatggcagattggctccaggacctcccatggataccaagatctggggatgctcaaatccgaaagacaaaatggcatagtatgtgcatataacctcacatcctcctgtatactttaaatcacctctggattacttataatacctagtaagatgtaaatgctatgtaaatagttgtcatactgtatttagaaaataatgacatggaaaacagtctgtacatgttcagcacagatgtaatttttaaaaaatatttttcatccacagttggcttaatccatagatgtagatgccacagatacagaggtctgactgtgtaaactcatctagcattacttaacttttcaccacaatctgccttcttgtttccaaaagacatctgcagtttctcacttgggctcatgctggtgtgtctccttatgctggtgcctcttcctcgactgccttactcctctattttcccagcatccatcatctcctatcaaatctagtctttaagaacccagaaaaaggcattttctgcattcccactaaaatgtaatctctcagggctaccaatgacagctgggtttatagcacttactttgttgtgctccctattgttctcatcagtgtattcacttaacccttgcctagacagcgaggtctttgagaaaaaagggcggattcaagctatatttttaaagggttaattaacttaatagaatgtagtttttatggggcaaaaaaaaaagttgtaggcttgttataaggtaaagaaaaatgtattaaaagtcaagaaaatatgagcctatacttatagagaaatttcaaatccattagctgacactcaaatctttgttgagttgaaatcgtatggaaataactggctatcaatttgaggactacaataaactaatcttaattatagtttaaatcttaatataaaatgagaatatggaaagaaacgtcatttttgtggtgtcagactaacagtttcccccttttattattttttttgagacagagtctctgtcaccaggctggagcgcagtggcacaatctcggctcactgcaacctctgcctcccaggttcaagcaattgtcctgcctcagcctcccaagtagctgggactacaggcgcgtgccatcacccccagctaatttttgtatttttagtacagacagggttttaccatgttggccaggatagtcttgatctcttgacctcgtgatccacctgccttgtcctcccaaagtgctgggattacagacatgagccaccgtgcctgctcccgctttttttttttttttgagatagagtctcactcaggctggaatgaaataaagaggaatgaatttcttgagacaaatgaaaatgaacacaacacactaaaacccatgcaatacagcaaaagcagttcttagtgggacgtttatagcagtaagtgcctacatcacaaaaggaggaagatcttcagcaatgtaatattgtattatacctcaaggaactagaaaaaagaacaaactaaacacaaaattagtagaaggaaggaaataataaagatcagagcagaaataaatggaatagagacttaaaaaattacaaaagattggccaagtgcggtggctcatgcctgcaatcccagcactttgggaggccgaggcgggcggatcaccaggtcaggagattgagaccatcctgactaacatggtgaaaccccgtctctactaaaaatacaaaaaattagccgggcgtggtggcaggcgcctgtagtcccagctactcaggaggctgaggcaggagaatggcgtgaacccaggaggcggagcttgcagtgggccgagattgcaccactgcactccagcctgggtgacagagcgagactccatctcgaaaaataaaataaaataaaattatggaagatcaacaagataaagagttggtttttgaaaagataaatctttagctggactaagaaaaaagtagactccaaatcagagacgaaggagacattgcaactgattctacagaaatataagggatcaggctgggtgtggtggctcatgcctatagtcccagcactttgggaggctgaatcagggagatcgcttgaggtcaggagttcaagagcagcttggccaacatgctgaaaccccatctctacgaaaaatagaggtgggcacctgtaatcccagctacttgggaggctgagacagaagaatcacttgaacctgggaggcagaggttgcagtgagccaagattgcaccactgtactccagcctgggcaacagagcgaaactccatctcaaaaaaaaaaaaaaaaaaaaaaggatcataagaaactgttatgccaacaaatcagatcacctagaagaaatacgtaaaggtaaactcttggacacatccaatctaccaatattgaattataaagaaacaaaaaatctgaacagaggccagttgtagtggttcacacctgtaatctgagcattttgggaggctgaggtgggtggaccacttgagcctggaagtgagagaccagcctggacaacatagtaagaccctatttctactaaaaataaaatgaaaaattagttgggtgtggtggtccacacctgtggtgccagctactcagaaggctgagggaggactgcgtgagcctaggagtttgaggctgcggtgagctatgatcacaccagaacactccagcctgggcaacatagcaagacactgtctcaaaaaaaaaaatctgaacagaccaataaagaacaaggagattaaaccagtaataaaaagcctcccagggaagaaaagcccaggaacagatggcttcactcctgaattctaccaaacatttaaagaattagtactaaaaatttaagaaaatggaatacttccaaacttatcccacaaggtcagcattatcctgataccaaaagccaaacatatcaaaaccaaacaaggacataacaaaaaaagaaagagaactacaggccaatatccctgatgaacatagatgtaaaaatcttcaacaacaacaaaattcagcaaaccaaattcaacaacccatgaaaacggtcatccatcatgatcaagcgcaattcatcccaggaatttgtgggtggttcaatttacacaagtcaataaatgatacacagtgttaacagaatgacagacaaaaaccttataatcatttcaatagatgcagaaaaggcatttgacaaaattcaaaattcctttatgataaaaactctaaacaaattatgtatagaaggattgtacctcaaaacaataaagaccatatatgacaaacccatagctaacatcataccgaatagggaaaagttgaaaccctttatgctaagatctggaacaagacaagcatgctcacattggccactactattcaacatagtactgaaagtgctagcaagagaaagaaaagtaattgaaattggaaaggaagaagttaaatttgtccctgtttgcagagacatgatcttatataagaaaccctaaactctccatcaaaaaaactgttagaactaataaattcagtaaagctgcaggatacaaaaatgaacagaatttatatgcagtaacagcaaactctaaaaaatcaagaaaacaatccatttgcaatagctaccaaaaaataaaatacttaggaagaaatttaaccaaggaggtgaaagatttctacactaaagactgtaaaacattcataaattaaagaaaatacaataaagtctttgttgatagattggaaaaagtattgttataaaatgtctatactacccaaagcaatctaaagtacaatccctatcaaagtgaaatagaaaaaaaatgctaaatttgtattgaaccacggaagatcctgaataaccaaagcagtcttgagcataaagaacaaagctggaaataccacattatctgacttcaaaatgtactacaaagctgtagtaactcaaacagcatggtactggcataagaacagacatagatcaatggaacagaatagagagacgaaaaattcatgcatttacagtaaatggattctttacaaaggcaccaagaatacacaatgaggaaaggacaatgtcttcaataaatgatgctgggaaaactggataccacatgtagaagaatgaaattaaactctctcatcttttataagaaaaaatcaattcaaaatggattaaagacctcaaactgtgaaacttctagaagaaaacatagggggagagcttcatgacattggtccaggcaatgatatgacctaaatagcataagtaacaaaagcaaaaatagacaaatggaattacatcacactgaaaactttctgcacagcaagcgatcaacagggtgaagacataccctacaaaatgggagaaaatgtttgcaaagtatgtatttgataagggattaatatccaaaatatataaggaactgaaataatgcaatagaaacaaataactggattttttaaatgggccaaagacctcaatagccatttctcaaagaagacatataaatggccaacaggtatatgaaaaaaatgctcaacatcactaatcataagggaaatacatatcaaaactacaaggaaatatcacctcctgttagaattgctattatcaaaaaaaaaaaagataagtgttggcaaggatatgaagtaaagggaacccttacacaccgtaagtaggaatataaattagtacagccattatggaaaacagtatggaagtgcctcaaaaaattataaactgaactactgtatgacaacatatgattgagcaatcccactactgggtctatatccaaagaaaataaaatcagtatgctgaagatatctgttctcccttgttcatcgcagcattattcacaatagctaagatatggaagctaagcgttcatcagtggctaaataaagaaaatatatgtatacacaatggaatacttactattcagcctgtaatttgtgataacagatgaacatggaggatgtatgtttagcaaaatgaaccagacacagaaaactaccatgtgatttccctcatatgtggaatctaagaagtttatctcagaagtagagactagaatggtggttaccagagggttgggtggttagtgggcttggggagttggggagatgttggcaatgagtacatatttacaattaggagaaataagttcaagacatctaatgtaccgcattatcttgctaatgtacagtaagatgacattaacgatgtattgaaaaatatttagaatggatgttgtgttctcacaaatatatcagataatgcatatgttaattagctagatttaaccattctgcaatgtatatataaagaacatcatgttgtacatgataaatatgattttatatgtcaaattaaacaaatttgaaaaggaaaatggaaaaaatgcatatataggaggatagcagacatgacaacatctggataatagcattatacaggacagaaagattaaaatggagatgaaaaattattagaataaatattggagacaaatttctcattaaagaacgataaactacttcaaattcagtgttcagagagtactaagtagaagaggtgagaacccatacctagacatataatgacatctccaaacatctcagcggttttgccacaaaggattcattttaaaaacatttttggaggaactgtttaaataagagaaatagaaccagcagatgttggcctggaccactttactaccttgctaacatgtctcactccttcaccccactttaggaacttagtgtagctcagaatctttttactattcacacacatttgaataaattctcggctaaatataaaatttgtttcaaagtaattttccagcaatcctgagcaaaaagaacaaaactggagacatcacataacctgacttcaaaatatgttacaaagctatagtaaccaaaacatcatggtattagtataaaaataaacacatagaccaatggaacagaatagaggatccagaaataaagccatgtatttgcagccagctgatcttcaacaaagccaacaagatcttacactggggaaaaaagactatcttcaacaaatagtgctgggaaaattggatggccacatgcagaagaatgaaactggaccccttacctctcaccatacaccaagtaaattcaaagtgcattaaagactttaaatataagacccaaaactataaaaatactagaagcaaatctagggaaaactctcttggatattgttctaggcaaagaatgtatgacttaagacctcaaaagtacagggaacaaaaccaaaaacagaaaaatgggacttaattaaactaaaaagcttctctacagcagaataagtgagtgaagagacaacctattaaatgggagaaaatatttgcaagccattcatttgacaggtgactaatatccagaatacacaaggaactcaaacaactcaacagttaacaacaaaagaataaaaaagtggacaaaggacataatagacaactctcaaaagaagacatacaaatggccaagaggtgaaagaaaaatgcttaacaccactaatcatcaggtaaatgcaaatcaaaaccacaatgagataatatcttaccctagtcagaatggctaccattaaaaagacaaaaaaaaaaatgctggcaagaatgcagagaaaagggaactcttattcactgtgggtgggaatgtaaactagtacaaccactatggaaaacagcatggagatttctcaaaaaactcaaatagaattaccatttaatctagcagtcccaccactaggtatctactcaaaggaaaatgaagcaatatatcaaaggaaaacctgcattcacatgtttattacagcagtattcatagtaaggcttgtgcctctctgggatgaagctatgagagaaagaaacaggtagcaatatttgctgttctgcaggctctgcaggctctgcagacccaggcaaacagggtctggagtggacctccagcaaactccagcagacctgcagaagaggggcctgactgttagaaggaaaactaatagaaagcaataatatcaacatcaacaaaaaggatgtccatgcaaaaaccccatccaaaggtcctcagcatcaaacatcaaaggtacataaatccatgaagataaggaaaaaccagtgcagaaatgctgaaaattccaaaaaccacaatgcctcttctctttgaaaggatcacaactcctcaccagcaagggaccaaaactggatggagaatgagtttgatgaattgacagaagtaggcttcagaaggtgggtaataacactcctctgagctaaaggagcatgttctaacccaatgcaaggaagctaagaaaccttgataaaaggttataggaaatgctaacgagaataaccggtttagaaaagaacatgaatgacccaatgaaactgaaaaacacagcatgagaatttcatgaagcatacacaagtatcagtagccaaattggtcaagcggaagaaaggatatcagagattgaagatcaacttagtgaaataaagcgtgaaaacaagattagagaaaaaatgaaaaggaatgaacaaagcctcccaagacatatgagactatgtgaaaagaccaaacctacgattgattggtgtacctgaaagtgatggagaatggaaccaagttggaaaacacacttcaggatattatccaggagaacttccccaaattagtgagacagggcaacattcaaattcaggaaatacagacaacaccactaagatactccttgagaagagcaaccccaagacacatgattgtgagattcaccaagactgaaatgaaggaaataatgttaagggcagccagagagaaaggtcaggttacccataaagggaagcccatcagacttaacagtggatctctctgcggaaacgccacaagccagaagagagtgggggccaatattcaacattcttaaagaaaataactttcaacccagaattttatatcgagacaaactaagcttgatcagtgaaggagaaataaaatcctttccagacaagcaaatgctgagggattttgtcaccaccagtcctgccttacaggaattcctgaaggaagcactaaatatggaaaggaaaaaatcagtaccagctactgcaaaaacatgccaaaatataaagaccaataacactatgaagaaactgcatcaactaatgtgcaaaataaccagctaacatcatgacaacaggatcagattcacacataacaatattaacaataaacgtaaatgggctaaatgccccaattgaaagacgcagactggcaaattggatagagtaaagacccatcggtgtgctgtattcaggagacccatttcatatgcaaagacacacatgggctcaaaataaagggatgaaggaatatttaccaagcaaatggaaagcaaaagaagcagggtttgcaatcctagtctctgataaaacagactttaagtccaggaccagatggattcacagccgaattctaccagaggtacaagaaggagctggtaccattccttctgaaactattccaatcaatagaaaaagagggaatcctccctaactcattttatgaggccagcatcatcctgataccaaagcctggcacagacacaaccaaaaaagagaattttagaccaatatccttgatgaacattggtgcaaaaatcctcaataaaatactggcaaaccaaatccagcagcacatcaaaaagcttatccaccatgatcaagtgggcttcatccctgggatgcaaggctggttcaacatatgcaaatcagtaaaagtaatccagcatataaacagagccaaagacaaaaaccacatgattatctcaatagatgcagaaaaggcctttgacaaaattcaacaacccttcatgctaaaaactcaataaattaggtattgatgggacgtatctcaaaataataagagctatctatgacaaacccacagccaatatcatactgaatgggcaaaaactggaagcattccctttgaaaactggcacaagacagggatgccctctctcaccactcccattcaacatagtgttggaagttctggccagggcaattaggcaggagaaggaaataaagggtattcaattaggaaaagaggaagtcaaattgtccctgtttgcacatgacatgattgtatatctagaaaaccccattgtctcagcccaaaatctccttaagctgataagcaacttcagcaaagtctcaggatacaaaatcaatgtacaaaaatcacaagcattcatatacaccaataacagacagccaaatcatgagtgaactcccattcacaattgcttcaaagagaataaaatacctaggaatccaacttacaagggatgtgaaggacctcttcaaggagaaatacaaaccactgctcaatgaaataaaagaggatacaaacaaatggaagaacattccatgctcataggtaggaagaatcaatatcgtgaaaatggccatactgcccaaggtaatttatagattcaatgccatccctatcaagctaccaatgactttcttcacagaattggaaaaaactactttaaagttcacatggaaccaaaaaagagcccgcatcgccaagtcaatcttaagccaaaagaacaaagccggaggcatcatgctacctgacttcaaactgtactacagggctacagtaaccaaaacagcatggtactggtaccaaaacagagatatagatcaatggaacagaacagagccgtcagaaataacgccgtatatctacaactgtctgatctttgacaaacctgacaaaaacaagaaatggggaaaggattccctatttaataaatggtgctgggaaaactggctagccatatgtagaaaggtgaaactggatcccttccttacacctgatacaaaaatcaattcaagatggattaaagacttacatgttagacctaaaaccatgaaaactctagaataaaacctaggcaataccattcaggacataggcatgggcaaggacttaatgtctaaaacaccaaaagccatggcaacaaaagccaaaattgacaaatgggatctaattaaactaaagagcttctgcacagcaaaagaaactaccatcagagtgaacaggcaacctacaaaatgggaggaaatttttgcaacctactcttctgacaaagggctaatatccagaatctacaatgaactcaagcaaatttacaagaaaaaaccaaacaaccccatcaaaaagtgggtgaaggatatgaacagacacttctcaaaagaagacatttatgcagccaaaaaacacatgaaaaaatgcccatcatcactggccatcagagaaatgcaaataaaaaccacaatgagataccatctcacaccagttagaatggcgatcattaaaaagtcaggaaagaacaggtgctggagaggatgtggagaaataggaacacttttacactgtttgtgggatggtaaactagttcaaccattgtggaagtcagtgtggcgattccgcaggaatctagaactagaaataccatttgacccagccatctcattactaggtatatacccaaaggattataaatcatgctgctataaagacacatgcacatgtatgtttattgcggcactattcacaacagcaaagacttggaaccaacccaaatgtccaacaatgatagactggattaagaaaatgtggcacatatacatcatggaagactatgcagccataaaaaatgatgagttcatgtcctttgtagggacggatgaaactggaagccatcattctcagcaaactatcgcaaggacaaaacaacaaacacagcatattctcactcataggtgggaaatgaacaatgagaacacatggacacaggaaggggaacatcacactccggggactgttgtgggatggggggagtgtggagggatagcattaggagatatacctaatgctaaatgacgagttaatgggtgcagcacaccaacatggcacatgtatacatatgtaagaaacttgcacattgtgcacatgtaccctaaaacttaaagtataataataataagaaaataataaaatgaaaagactttaaaccaacaaggataaaaaaagacaaagaagggcattacataatggtaaagagatcaatgcaacaagaagagctaactattctaaatatatacaatacaggagcacctagattcataaagcaagttcttagagatctacaaagagatgtagactcccaaacaataataatgggagactttaacaccccactgtcaacattagatcaacaagacaaaaattaacaaggatatccaagacttgaactcatctctggaccaagtggacctaatagatatctacagaactctccaccctaaatcaacagagtatacattcttctcagcaccatatcacacttattctaaaattgaccacataattggaagtaaaacacgcctcagcaaatgcagaagaatggaaatcataacaaacagtctctgagaccacagtgcaatcaaattagaactcaggattaagaaactcactcaaaactgcacaactacatggaaactgaacaacctgttcctaagtgactactgggtaaataacgaaattaaggcagaaataaataagttctttgaaaccagtgagaacaaagacacaacataacagaatctctgggacacagcagtgcttagagggaaatttacagcactaaatgcccacaggagaacgtgggaaagttctaaaattgacactctaacatcataattaaaagaactagaaaagcaagagcaaacacattcaaaagctagcagaagacaaataactaagatcagagcagaactgaaggagacagagacacaaaaaacccttcaaaaaatcaatgaatccaggagctggttttttgtaaagattaacaaaataataccactggccaggataataaaaaagagaagaatgaaatagacacaataaaaatgataaaggggagatcaccactgatcccacggaaatacaaactaccatcagagaatactataaacacctctatgcaaataaactagaaaatctagaagaaatggataaatgcctggatttatataccctcccaagactaaaccaagaagaagtcgaatccctgaacagaccaataacaagttctgaaattgaggcagtaattaacagcctaccaacctaaaaaggcccaggtccagatggattcacagctgaattctaccagaggtacaaagaggagctgataccattccttctgtaactattccaaacaatagaaaaagagggactcctccttctcattttatgaggccagcatcatgctgataccaaaacctggtagagacacaacaaaaaaaaaagaaataccctgatgaacatcaatgcgaaaatcctcaataaaatactggcaaactgaatccagcagcccattaaaaagcttatccactatgatcaagtcaccttcatccctaggatgcaaggctggttcaacatatgcaaatcaataatcataaaccatcacataaacagaagcaatgacaaaaaccacatgattatctcaatagatgcagaaaaaagcctttgataaaattcaacacctcttcatgctaaaaacactcaactaggtattgacggaacatatctcaaaataataagatctatttatgacacacccacagccaataaatgtgatactgaatgggcaaaagctggaagcagcttttgaaaaccagcacaacacaaggatgtcctctctcaccactcctattcaacatagtattggaagttctggccagggcaattaggcaagagaaaaaaaataaagggtattcaaatcggaagggaggaagtcaaattgtctctgtttgcagttgacatgattgtgtatttagaaaaccccattgttggccaggcacagtggctcatgcctgtaatcccagcactttgggaggctgagatgggtggatcatgaggtcaagagatcaagactatactggccaatatggtgaaaccctatctctactaaaaaaacaaacattagctgggtgtggtggtgcgcacctgtagtcccagctactcgggaggctgaggcaggagaatcgcttgaacccaggaggcagaggttgcagtgagctgagattgtgccactgcactgcagcctggtgacagagtgagactccgtctcaaaggaaaaaaaaaaaaaagaaaaaaccctatcgtctcagccccagaactccttaagctgataagccacttcagcaaagtctgaggatacaaaatcaatgtgcaaaaatcacaagcattcctatacatcaataatagacaaacagagagccaaatcatgagtgaacttccattcacatttgctagaaagagaattaaatacccagcaatacaacttacaagatatgtgaaggacctcttcaaggagaactacaaaccactgctcaaggaaataagagagaacacaaacaaatggaaaaacattccatgctcatggataggaagaatcaatatcatgaaaatggccatactgctcaaagtaatttatagattcaatgctatcctgtctcctgtatagccaagacaaccctaagcaaaaagaacaaagctggaggcatcatgctacctgacttcaaactatactacaagactacagtaaccaaaacagcatggtactggtatcaaaacagatatataccaatatatagtatcaaaacaaatatataccaatagaacagaagagaggcctcagaaataacaccacacatctacaaccatctgatctttgacacacctgacaaaaacaggcaatggggaaatgcttccctatttaataaatggtgttgggaaaactggctagccatatgcagaaaactgaaactagaccccttccttacacctcatacgaaaattaactcaaaatggattaaagacttaaacgtatgacctaaaaccataaaaaccctaaaagaaaacctaggcaataccattcaggacataggcaagggcaaagacttcatgactaaaacatcaaaagtaatggcaacaaaagccaaaattcacaaatgggatctatttaaactaacgagcttctgaacagcaaaagaaactatcatcagaatgaacaggcaacctacagagtgggagaaaatttttgcaatctatccatctgacagagggctaacatctagaatctacaaagaacttaaataaatttacaagaaaaaaacagccccatgaaaaagtgggtaaaggatatgaacagacacttttcaacagaagacatttatgcagccaacagacacaggaaaaaatgctcatcatcactggccatcagagaaatgcaaatcaaagccacaatgagatactgtctcacgccagttagaatgattaaaaagtcaggaaacaacagatgctggagaggatgtggagaaataggaatgcttttacactgttggtgagagtgtaaattagttcgaccattgtggaagacagtgtggcgattcctcaaggatctagaaccagaaataccatgtgatccagcaaccccattactgggtatataccccaattattataaatcattctgctataaagactcatgcacacgtatgtttattgcagcactgttcacaatagcaaagacttggaaccaacccaaatgcccatcaatgatagactggattaaaaaaatgtggcacatatacaccatggaatactatgcatccaaaataaaatggatgagttcatttcctttgcaggaacatggaggaagctggaaaccatcattctcagcaaactaacacaggaacagaaactgcaacaccgcatgttctcactcataagtgggagttgaacagtaagaacacatggacacagtgaggggaacatcatacaccagggcctgtcagggggtgggggcctaggggagggatagcattaggagaaatacctaatgtagatgacgggttgatgggtgcagcaaaccaccatggcacgtgtatacctatgtatacattctgcacatgtatctcagaacttaaagtgtattaaaaaaaaaaaaagaattcttttagaattagctacagctaatggataaagaaaaacttggagaagttgagcaatacaataaaatttggtttaagagataatatgtagaacttaacgtgccttaaaaaagaatataaatcttttttatataccatgagacatttataaaaattgattatgtaattgactccagaggaagccataaactttaaaaaacagagagcaaaaaggagcagaaagggaggggggaggagaaagggctaataaatatgtaaacagtcactatgcttcatttgcagtcaaggatgcatattaaagtaacaatgtacacttcctaccattaaactgacaaaatttagagtgacaaaatctactgttgacagtgataggctactttcatacctttttggtagaaatatgaggtattacagcctttttaaaaagccacctgacaatatttgttaaaatttaaactacacatacccttctaccacgtgttcccaattctggaactctatcacatagatataaaagcagaagtatgtaaatgatatgcttacacagatgtattaacagctgattttcattactaaataccagaatgaccatgccatttgtttacagatggtaaacaattgtcctatttgaactagcaaaacctctggttggttgagttctgtgtcatactgcttactgttatttttagtatcactccagtatgtaatggatatatatgtctatgtaggtatgagtgtatggtttgtagtggcaaaaaaataaaacctcagacaagttaaatgttcactaacagaggaaaaatggttaaatagatggtacatccatattacataaaacattttgtagccgtttaggagtttgattgtgatggataaaaataagataaagaaagttgtagcagaaagtgctagttgccagcatgatatctattcttcctcagtatgaaacaagacgctgtttgttagtgtgtgtgtgtaatgtatccagttaaacaatgacacattccagctatgtttgctgctagcagtggccatgtcactaggttatagctaatgataggtaggtgaaaattgttgggtgggctttatgtgaaatagcttgcagattgtaaagcgtcttctgcttctggccatgaggaagtaattgagtccagaattatgcttccactatagactattagaaaactggaccaataaaacaaacaaacaacaaggaaaaaaacggttttaagcattggaaaatggaaagctcagaactataacacctgaaagaagtgaaagaaacaaagtgagccttaggcaccaaagctttactctcacagacaatttttggactgtggcaccaggagggaacccagacaaatcatgacaaactgttaagtaaaagagagaccatagttcaagggagcttggattttggcatagagtaaccaagaggagggagaaagagaggaagacttccagatatatgtatagttgtctctatattgtcctatttgaactagcaaaacttctggttggttgagttccgtgtcatactgcttactgttatttttaatatcactccagtatgtaatggaaatctgtgaatggtagggtaaacctccaagaggctgggcaagaacagcttcttggagaaaaaaaaaaaaacagctgctaggaagaagacaaaaatattcctagagatcacactgagctagagattattatagttcccagagcagccagactggaaagatagagagaccacattgagtacacagagcatttagtagagaacccagaaaggccatgccttggaagtggggccaagttagccctagaataaagaagactatagacttaccctgaaagaacttaaaaacaagtttcaaaagaataaaacaacacaagtaatttaactgctagagagaacaaactccaacaatctttttctttttaatgcaaaaaaaaaaaatccagcaaccagccatgtataatttacaatgtccagcttctaacaaaaagtgttaaacattgggcagaaaaataaggcccataacctggtgtattagtccgttttcacactgctgataaagacatacccgagaaggggcaatttacaaaagaaagaggtttactggacttacagtctcccttggcttgggaggcctcataatcatggtggaaggtgaaagacacatctcacatggtaacagtcaggagaagagcgcttgtgcagggaaactcccgtttttaaaaccatcagatctcgttagacttattcactatcacgagaacagcacaggaaagacccacccccatgattcaattacttcccaccaggatcctcctgtgacacgtgggaattgtaagagttacaattcaagatgagatgtggatagggacacagccaaaccatatcacctggagaacattcagacaatagaaacagactcagaaatgaaaaagatgatagaactagtagataaggatgttaaaacagattctataaatacgtgcatatgttcaaaaatgcaaaataaacatgaacataatgagataaatggaagatataaatatggacacagtagaactcctagaggtgacatataaaacaccaggataaaacatttactgtataggactaatggcaggtcagagactgtagaaggaaatattaaacttagagacttggcaacagaatatatacaaaatgcatcaaagagaaaaagaacactgataaagtctcagtgacttgtggggctattaaagcacatggtatatacatatttggtgtctcagaaagagatgagacagactggggcagaaaaataacggctcaacagtttctaatttttttgaaagctataaatacagagaataaaaaatctcaatgatcttcaagaaagagacacataatacacacacaccccaaaccactccaaagcatacaacaatcaagttactgaaaactagaaaactgtttgactaaaaaaagatactttacatatatcggaacaactagaaaaagacattgcacacacataggaaaaagattagtatggatttcttataagaaattacttacagctaaaaacaatgggacagtgacttttaagtaccgataacaaaacagaacaaccccctgaaaaaaaaacaaaaacaaaaacaaaacaaaaaaccttgtctatccacaattttctatccagtgaaattatccctcagaaatgaatactaaggtgggggccaagatggccaactagaagcagcagtgatcagaggctcccatcgaaagaaccataatagcatgtgaatcctgcaccaccaaccaaggtatccaggatctctcaccagaactgactaggcagctggtgtgatccatggagaggaaggaagagcagtgtggtatgactgcacacccaagagccacatggagcaggggaaaccccactccccaagccaggggaggcagtgagagtgctacccagctgaggaaactgtgctttttccatggaactgtgcaatccatggattagaagatcccactcgcgatcccatgccactggggcctagggtcccaacctcagacctgtgcagattctctacagcctctcagctagaatttgcttaagcctgccaagttacaggggagaggggtgaccagcaccacagctgcagctgcctgctgtctacaccatttgagctccttggggaaggggcagcagccagcactgggactcataactgcttatcacactaagctccctgggcaggagaagggcggcatccatctctatagctccaggttgcacttttccactgctggagccaatgaggtgggacagcttggtcacaagaggtgtctcccacagcccaacacactggctgtggcagactggccagactgcctcttcaggcctgggtggggcccccatgcaggaactcttaacaactccagccagaggctccgggacaggaccctgatctccctgggcctgacccttttggggtaggggtggccgtagtatctgtcgaccagcagacttagcctttcctcctggtagttttgagtaattgcagcagcccagatgagtgggtttcccccagcgaagcacaccctctccaccaagggacaaagtgcttcattaaacaggtcctgttccctgtgccatgcaatgaggtgagaccctcaaaaaggggttgtcagacatcctatacaggagtgatactactggcatcaggttggtgccccttgaggtcagagatctcagaataaggagcaggaacttacctttgctgttctccagccttcttgagtgacatctgcaggcataggagtgaaccagaggaatatggcctgaagtgaaaccccagcaaactgcagcagccctacagaagagggacctgactattgaaagaaaaacaaacgaaaagcaacaacagcatcaacaacaaaaaaagtccccacaaaaaccccatccaagagtcagcagcctcaaagatcgaaactagacaaactcatggtgataagaaaaaaatcaacgaaaaaatgttgaaaacccaaaaggccaaagtgccccttcttcaaatgatcgcaacgcctctctagcaagggcacagaattggacagaggatgagatggaagaattgacagaagtaggcttcagaagatgagtaataaaaaaaacttctgctgagctaaaggatgatgatctaagccaatgcaaagaagctaagaacctttataaaaggttagaggagctaactagattaaccagtttaaagaggaacataaatgacgtgatgcagctgaaaaacacagcatgagaacttcgtgaagcatacacaagaatcaatagccaaatcgaccaagtggaagaaaggatatcagagtttgaagaccaccttgctaaagtaaggcatgcagacaagattagagaaaaaagaatgaaaaggagcacacaaagcctccaagaaatatgggactatgtaaaaagaccaaacctatgattggagtacctgaaggagacggggagaatggaaacaagctggaaaacacctcaggatattatccaggagaacttccccaacctagcaagacaggccaacatgcaaattcaggaaatacagagaacaccactaagatactccatgagaagatcaaccccaagacacataattgtcagatttaccaaggtgaaatgaaggaaaaaatgttaaggccagccagagaaaaaggtcacgtcacctacaaagggaagcccatcagactaacagcagacctttcagcagaaaccctacaagccagaagagattgtgagccaatatcaaacattcttaaagaaaagaatttccaacccagagtttcatagctggccaaactaagcctcataagtgaaggagaaataaaatcctttccagaaaagcaaatgctgagggattttgtcaccaccaggcctgccttgcaggagctcctgaaggagacactaaatatggaaaggaaaaactggtaccaaccactgcaaaaaacacaccaaaatataaataccaatgacactatgaagaaactgcatcaactagtgtgcaaaataagcagctagcatcatgatgacagtatcaaattcacacataacaaaactaaccttggccgggagcagtggctcatgcctgtaatcccagcactttgggaggccaaggcaggtggatcacctaaggtcaggagtgcgagaccagctgggccaacatggtgaaagccccgtctctactaaaaatacaaaaattagctgggtatggtggcaggcacctgtaatcccagctactcaggaggcttaggcaggagaatcgcttgaatccagggggcagaggttacagtcagccgagatcatgccattgcactccagcctggacaacaagagtgaaaccttgtccaaaaaaaaaaaaaaaaaaaaaaaaaaccttaaatgcaaatgggctaaatgctccaattaaaagacaaagactggcaaattcgataaggagtcaagacccattgatcggtgtgctgtatttaggagacccatctcacatgcaaagacacacattggcacaaaataaaaggatggggggaaatttactaaccaaatggaaagcagaaaataaaaattaaaaataaaaaaaggaggggttgcaatcctagtctctgacaaaacagactttaaaccaacaaagatcagaaaagacaaagaaggcagtcccagccaccaaccccagacagtggaatccttgggctcctgagcttcaggatgattcatgctgagatggaccctgaagaagcactttgttggcaatcctactaatagtgactttgagttgaagacagctgagctcccacccttaaaaaatagagaggtcctgcttgaagctttgttcctcactggggacccttacatgagagtggcagccaaaagactgaaggaaggtgatacaatgatggggcagcaagtggccagatttgtggaaagtaaaaacgcagccttaccaacagaactattgtactggctccttcaggctggacagcacactccattgctcatggaaaagatctggaaaacctgccaacagaatggcctgacacagtaccactgtctctggctctggggacagttagcatgacaggcctcactgcctactttggcctacttgacatctgtggtgtgaagggtggagaaacagtgatggttaatgcagcagctggagctgtgggctctgttttggggcagattacaaagctcaagggctgcaaagtggttggagcagtagggtctgacgaaaagactgcctgccttaaaaagcttggatctgatgtctttaactacaagacagtagagtctttgaagaaactttgaagaaagcctctcctgatggttacaattgttattttggtaatgtaagtggatggttttcaaacactgttatctcccagatgaagaaatttggaagaattgccacatgtggagctatctctatatataacatatacatatctacatataacacctgtaatcccagtactttgggagaatgaggcaggtggatcacctgaggtcaggagtttgagaccagcctggccaacatggtgaaacccccgtctctaccaaaaatacaaaaattagccgggtgtggtggtaccagcccacttcccccaggcccaatcccagagattgttagatgtatcaggagcttcacatggaagggttcattgtgacctgctggccaggagatgcccaccaaaaagctctaaaggacttgctgaaatgggtctcagagggtcaaatccagtaccaggaatatatcattgaaggatatgaaaacatgccagctgcatttatgggaatgctgaaaggagataatttggaaaaacaatagtgaaagcgtgaaaaaaaatgacacatggaatctgaatgccatttaggtgattacttgtttttcaccatttagcaaaaatgtgtactacgttaaatgtctaagaaatagtactagtaacgggtttgacctacctaataaaatacatttaactggtatgtaattagtgatggaggatgaaaatttcagagccaacaacaaccagccacctcactgttcactacagcttcttctgagttgtggtagaaaataatggctttggagtttgaaagtttatcaaacactgcatgttctcactcataagtgaaagctgtacaatgagaaaacatggacacggggaagggaacaacacatactggggcctatggggggtgggaggaaggagagcatcagaataaatagctaatgctgtggggcttaatacctaggtaatgggttgataggtgcagcaaaccaccatggtgtacgtttacctatgaaacaaacctacacattctgcacatgcatcccagaacgtgaaataaaataaaaattaaaaaaaaaagaaagacaaagaagggcactacataatggtaaagggatcaattcaacaagaaaagctaactgtcctaaatatacatgaacccaatataggagcacccagattcataaaacaagttcttagagacctacaaagagacttagactctcacacaataatagtgggagactttaacactccactgtcgatattagacagatcaatgtgacagaaaattaacaaggatattcaggacttgaactcagctctggatcaagtgaacctaatagacgtctacagaactctccacctcaaatcaacacaatatacattcttctcagcaccacatagcacttactctaaaacagaccacataattacaattaaaacactccctcagcaaatggaaaagaactgaaatcataacaaaattatcttagaatatagtacaatctaattagaactcaggattaagaaattcactcaaaaccacaaaattacatgcaacttgaacaaccttctcctgaatgactcctggatatatgacgaaattaaggtagaaatccagaagttctttgaaaccgatgagaacaaagagacaatataccggaatctctagaacacagctacagcactgttaagagggagatttatagcactaaatgcccatatcagaaagctaaaaatctcaaattgacaacctaacttcatcattaaaagagctagagaaacaagagcaaattagttttaaaactaggagaatacaagaaataaataacatcagagcacaaatgaaggagatagaaacacgaaaaaccctccaaaaaaaatcaatgaatccaggagctgggtttttttttttttttttttgaggtgatggatactttatttatcctaatgtgattactacaccttgcatgcctgtatcaaagtatctcacgtaccccatcaatatacatagctgctatgcacccacaaaattaaaaacttaaaaagaaaataagcacttttgtgtagcagacactatcagaaagtgaaaagacaacctattaaatgaaagaaaaaaaaattttttttttattatactttaagttttagggtacatgtgcacaatgtgcaggttagatacatatgtatacatgtgccatgctggtgcgctgcacccactaactcgtcatctagcattaggtatatctcctaaagctatccttcccccctcccccccaccccacaacagtccccagagtgtgatgttccccttcgtgtgtccatgtgttctcattgttcaattcccacctatgagtgagaatatgcagtgtttggttttttgttcttgcggtagtttactgagaatgatgatttctaatttcattcatgtccctacaaaggacatgaactcatcattttttatggctgcatagtattccatggtgtatatgtgccactttttcttaatccagtctatcattgttggacatttgggttggttccaagtctttgctattgtgaatagtgccacaataaacatacgtgtgcatgtgtctctatagcagcatgatttatagtcctttgggtatatacccagtaatgggatggctgggtcaaatggtatttctagttctagatacctgaggaatcgccacactgacttccacaatggttgaactagtttacagtcccaccaacagtgtaaaagtgttcctatttctccacatcctctccagcacctgttgtttcctgactttttaatgattgccattctaactggcgtgagatggtatctcattgtggttttgatttgcatttctctgatggccagtgatggtgagcattttttcatgtgttttttggctgcataaacgtcttcttttgagaagtgtctgttcatgtccttcgcccactttttaatggggttgtttttttcttgtaaatttgtttgagttcattgtagattctggatattagccctttgtcagatgagtaggttgtgaaaattttctcccattttgtaggttgcctgttcactctgatggtagtttctttagctgtgcagaagctctttagtttaattagatcccatttgtcaattttggcttttgttgccatggcttttggtgttttagacatgaagtccttgcccatgcctatgtcctgaatggtaaagcctaggttttcttctagggtttttatggtgttaggtctaaagtttaagtctttaattcatcttgaattgatttttgtataaggtgtaaggaagggatccagtttcagctttctgcatatggctagccagttttcccagcaccatttattaaataggaaatcctttccccattgcttgtttttctcaggtttgtcaaagatcagatagttgtagatatgcggcattatttctgagggctctgttctgttccattggtctatatctctgttttggtaccagtaccatgctgttttggttactgtagccttgtagaatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcactgaatctgtaaattaccttgggcagtatggccattttcacgatattgattcttcctacccatgagcatggaatgttcttccatttctttgtatcctcttttatttcactgagcagtggtttgtagttcttcttgaagaggtccttcacatcccttgtaagttggattcctaggtattttattctctttgaagcaattgtgaatgggagttcactcatgatttggctctctgtttgttattggtgtataagaatgcttgtgatttttgtacattgattttgtatcctgagactttgctgaagttgcttatcagcttaaggagattttgggctgagacaatggggttttcgagatatacaatcatgtcatgtgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaagggttgttgaattttgtcaaaggccttttctgcatctattgagataatcatgtggtttttgtctttggttctgtttatatgctggattacatttattgatttgagtatattgaaccagccttgaatcccagggatgaatcccacttgatcatggtggataagctttttgatgtgctgctggattcagtttgccagtattttattgaggatttttgcatcaatgtttatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagtgtgttattggtccattcagagattcaacttcttcctggtttagtcttgggagagtgtatgtgtcgaggaatttatccatttcttctagattttctagtttatttgcgtagaggtgtttgtagtattctctaataatagtttgtatttctgtgggatcggtgttgatatcccctttatcattttttattgcatctatttgattcttctctctttttttctttattagtcttgctagcagtttatcaattttgttgatcctttcaaaaaaccagctcctggattcactaattttttgaaggggtttttgtgtctctacttcctgcagttctgctctgattttagttatttcttgccttctgctagcttttgaatgtgtttgctcttgcttttctagttcttttaattgtgatgttaggtgtcaattttggatctttcctgctttctcttgtgggcatttagtgctataagtttccctctacacactgctttgaatgcatcccagagattctggtatgttgtgtcttagttctcgttggtttcaaagaacatctttatttctgccttcatttcgttatgtacccagtagtccttcaggagcaggttgttcagtttccatgtagttgagcggttttgagtgagattcttaatgctgagttctagtttgattgcactgtggtctgagagacagtttgttataatttctgttcttttacatttgctgaggagagctttacttcctactatgtggtcaattttggaataggtgtggtgtggtgctaaaaaaatgtatattctgttgatttggggtggagagttctgtagatgtctattaggtctgcttggtgcagagctgagttcaattcctgggtatccttgctgactttctgtctcgttgatctgtctaatgttgacagtggggtgttaaagtctcccattattaatgtgtgggagtctaagtgtctttgtaggtcactcaggacttgctttatgaatctggatgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctgtgtgtgtctctgcacgtgagatgggtttcctgaatacagcacactgaagggtcttgactctttatccaatttgccagtctgtgtcttttaattggagcatttagtccatttacatttaaagttaatactgttatgtgtgaatttgatcctgtcattatgatgttagctggtgattttgctcgttagttgatgcagtttcttcctagtctcgatggtctttacattttggcatgattttgcagtggctggtaccggttgttcctttccatgtttagcgcttccttcaggagctctttttgggcaggcccggtggtgacaaaatctctcagcatttgtttgtctgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctatatttcctgaatctgaatgttggcctgccttgctagattggggaagttctcctggataatatcctgcagagtgttttccaacttggttccattctccatgtcactttcaggtacaccaatcagatgtagatttggtcttttcacatagtcgcatatttcttggagcctttgcttgtttcttttcattctgttttctctaaacttcccttcttgcttcatttcattcatttcatcttccattgctgataccctttcttccagttgattgcatcggctcctgaggcttctgcattcttcacgtagttctcgagccttggttttcagccccatcagctcctttaagcacttctctgtattggttattctagttatacattcttctaaatttttttcaaagttttcaacttctttgcctttggtttgaatgtcctcccatagctcggagtaatttgatcgtctgaagccttcttctctcaactcgtcaaagtcattctccgtccagctttgttccgttgctggtgaggaactgcgttcctttggaggaggagaggcgttctgctttttagagtttccagtttttctgctctgtttttccccatctttgtcgttttatctacttttggtctttgatgatggtgatgtacagatggttttttggtgtggatgtcctttctgtttgttagttttccttctaacagacaggaccctcagctgcaggtctgttggagtacccagccgtgtgaggtgtcagtctgcccctgctggggtgtgcctcccagttaggcttctcgggggtcaggggtcagggacccacttgaggaggcagtctgcctgttctcagatctccagctgcgtgctgggagaaccactgctgttttcaaagctgtcagacagggacatttaagtctgcagaggttactgctgtctttttgtttgtctgtgccctgcccccagaggtggagcctatagaggcaggcatgcctccttgagctgtggtgggctccacccagttcgagcttcccggctgctttgtttacctaagcaagcctgggcaatggcaggtgcccctcccccagcctcgctgccgccttgcagtttgatctcagactgctgtgctagcaattagcgagactccgtgggcgtaggaccctccgagccacgtgcgagatataatctcctggtgtgccgttttttaagcccgtcggaaaagcgcagtattcggttgggagtgacccgattttccaggtgccatctgtcacccctttctttgactaggaaagggaactccctgaccccttgcgcttcccgagtgaggcaatgcctcgccctgctttggctcgtgcacggtgcacgcacccactgacctgcgcccactgtctggcactccctagtgagatgaacccggtacctcatatggaaatgcagaaatcacccgtcttctgcgtcgctcacgctgggaggtgtagaccggagctgttcctattcggccatcttggctcctcccccccctttttttttttttttttgaaaaaaaaaagaccactatctagactgataaataagaaaaaagagaagaatcaaatagacacaataaaaaatgacaaaggtgatatcaccactgaccccacagaaatacaaactaccatcagagaatactataaacacctctacacaaacaaactagaaaatctagaagaaatggagaaattcctcgacacttacaccctcccaagaataagccaggaagaggtcaaacccttgaatagaccaataacaacttatgaaattgaggcagtaatagcctaccaaccaaaaaaagcccaggaccagatgaattcacagccaaattctaccagaggtacaagtaggagctggtaccttttcttctgaaactattccaaacaattgaaaaggaaggactcctccctaactcattttatgaggccagcatcatcctgataccaaagcctggcagagatacaacaaaaaaagaaaacttcaggccaatattcctgatgaatatcgatgcaaaaatcttcaataaaatactgagaaaccaaatcgagtagccgttcaaaaaacttatccaccacgatcaagtcagcttcattgctgagatgcaatgcaaggctggctcaacatacacaaatcaataaatgtgatccatcacataaacagacccaaagacaaaaaccacatgattatctcaatggatgcagaaaaggcatttgataaaattcaacattcctttatatttaaaactctcaataacctaggtattgatggaacatatctcaaaatactaagagctctttatgaaaaacccacagccgatattgtactgaatgggcaaaaggtggaagcattccctttgaaaactgatacaaggcaaggatgccctctgtcaccactcctattcgacacagtattaaaagttctggccagggcaatcaggcaagagaaagaaataaagcgtattcaaataggaagggaggaagtcaaattgtctttgtttgcagacaatatgattctatatttagaaaaccccataatctcagccccaaaactccttaacctagtaagcagcttcagcaaagtttcaggatacaaaattgatatgcaaaagtcacaagcattcctatacaccaacaacagacaagcagagagccaaatcatgaatgaactcccattcacaattgctacaaagataattaaatacctaggaatataacttataaaggatgtggaggacctcttcaaggagaactacaaaccactgctcaaggaaataagagaggacacaaaaaaatgaaaaaaacattccattttcatggaatattcaatattgtgaaaatggccatactgcccaaagtaatttatagattcaatgctattcccatcaaactatccttgagattcttcacagaattagaaaaaacttaataaatgaagaccccgttttgccaagacagtccaaagcaaaaagaacaaagctggaggcatcatgctacctgacttcaaactatactacaaagcgatagtaacaaaaacaacatggtactggtaccaaaacagtcatatataccaatggaacagaatagagacctcagaaataacgctacacatctacaaccatctgatcttcaacaaacctaacaaaaacaagcaatggggaaaggcctcctattcaataaatggtgctgggaaaactggctagccatatacagaaaactgaaactggaccccttccttacaccttggacaaaaattaactcaagatggattaaagacttagatgtaaaacctcacattataaaaaccctagaagaaatctaggcaataccagtcaggacataggcttgagcaaagacttcatgatgaaaacgctaaaagctattgcaacagaagccaagttgacaaatgggatccaattaaactaaagagcttctgcacagcaaaagaaactatcaccagagtgaacaggcaacctacagaatgggtgaaattttttgcaacctacccatctgatgaagggctaatatccagaatttacaaggaacttaaacaaatttacaagaaagaaacaactccatcaaaaactaggtcaagtacatgaacagacacttctcaaaagaagacacttacacagccaacacacgtgaaaaaaagttcaacatactgatcattagagtaatgcaagtcaaaaccacaatgagaaccatctcatgccagtcagaatgacgactattaaaaagtcaacaaacaatagatgctggcgaggctgtgtagaaataagaacacttttacactcttggtgggaatgtaaattagttcaaccattgtaaaagatagtaaggcaattcctcaaggatcttgaaccagaaataccatttggccaagcaattccattactgggtatatacccaaaggaatgtaaatcattctgctataagcatacatgcacacatatgtttattacagcactatttataatagcaaagtcatggaacccccaaatgcccatcaatgatagactggataaagaaaatgtggtacatatacactgtggaatactgtgcagttataaaaaggcatgcgatcatgtcctttacagggacatggatgaacctggaagctatcatcctcagcaaactaacacaggaacagaaaaccaaacaccacatgttctcactcataagtgggagttgaacaatgagaacagatggacacagggaggggaacaacacacaccagggcctgttgggggttgggaggcgaggggagggaacttagaggacaggtcaataggtgcagcaaaccaccatggcacaggtatacctatgcaacaaatctgcatgttctgcacgtttccagaacttaaagtaaaattaaaatcaaaataaaaaaatgaatactaaatcaaaacttttcagataaacaaaagctgagaaaattaagcagaagcaagtctacattacaagaaatgttaaatgaagttctccagacaaaaggaaaatgatgtaacttgcaaacttatatctacacaaacaaatgaagagtactgcaaatagtagatatgtgggtacataaaaaagactattcccctcatttttaagatctttaatggataatttaattctaagatcaaaataatttagcatgtggttcataacacgcagaaataaaatgtatgacaacaatagcacaagggacagaatggggaataaaatactactttaagagtttcaaattatttgtgaaatatcattataacatttaaaagtagattataataaatcaaagatacatattttaaaccaaagagtagtgtaggcaaatggaaaaatgtgagccaaatatgtaatttcaaattttctagtagccacattaaaaatctaaaaagaaaccggtaaaattaattttaatgattttatttaacccaacaagaaaaaactgtcatgacaagaaaaaagctgaacaaattaaaaatcaccaactgagatctcccagagaattgaggtcacagggcaaactaccactccgaaaaccagagagatgggcagatacagtgaatcacaacttaccaggagcagaaactgttgaaatcagtaactgataggaacacttaaatagtaattgacaaatagctacagactgattgcaaattagcttgagaattaaaaactcctagtgacccagtgtagggttccccacacttatgattttacttctaaaagcccaaccaagggtctcacagtgaagatgaaagaaaacatctccttgtgctttgggaaggggaaaaggggaaagcaacccttttgaaattggcccagagtgttctattcttcataacaaagacctgccctcaacagaaactactttaccagggccttatctgatcaaacatgggggcaattagacaactctagtgcactctacccatcttgtctcacataaagaaggggaaaaaaggctaagaaattattctggaagttacatcccagggactttgctcatttgaaaaaaaaaaaaaagatttaagcagatgattatagaatgtttcccttcctgtcctccccaatactttattattacaatagggctccagtataataaaagtagattataactgagagcattagagacagagtctaattaagaagccatttctagggaaatccaaggatgacaaggtagacaaaaactaggacactagaggaaatttaaggctctgacacctatagctacagcaaatactaaatactgcataactcctagccagataaacataaaaccttacacgaaagccctatttacctcagttcctattagtataccacatacagctttcaaaacaaaaacaaaaactactcaagtcatcttaaaatgcaggaaaaggccaggtgcggtggctcatgcctctaatcccagcactttgggaggccgaggcggacagatcacaaggtcaggagttggagaccagcctgaaaaacaaggtgaaatcctgtctctactaaaaatacaaaaaattaaaaaattagccaggcatggtggcacttgcctgtaatcccagctactcaggaggctgaggcaggagaatcgcttgaacccaggaggcagaggttgcagtgagccgagatcttgccattgcactccagcctgggtgacagagtgagactctgtcaaaaaaaaaaaaagaagcaggaaaaaagacaagcagtctaaaaagacaatataagcattataaccagacccagctatgacacaaattgttttttctaggctggaaattttaaataactatgacctgttaagggctccaaagaaaatggtagacaacatgtaagaccagattggtaatgtaaacggagagatgaaaactctaagaaataatcaaaaacactgtgacaaaaataaagaatgcctttgatggtctcaatagactgaatatggctgaagaaagaatccatgaactcgaagatgaattaatagaaactcccacaacataaacgtaaagaccaaatagagtgaagcaattacaatagaacatccaactgtgaaacaatttcagtaagtgtagcacgcacaactgaaataccaggagaagaaaaagaatggagcagaagatatatttgaaataaaaatgtccaagacttttccaaaataatgacagacatgaaactgcagtttcagttagctcagagaacaccaagcaggataaatgtaaaaaaaaaacccactatacataggcatatcatattcaaacttcagaaaaagagaaatctttcaaaaaagccagaggaaagaacaacttacttacagagaaacaaggaagagtattacagataacttctcatcagaaaccacacaagcaggaagagaatggagtgaaagatttaaagtgttgagagaaataaacccactaacctgaattctatatctagtgaatttattcttcaaaactgaaggagaactaaagactatttcacagaaacaaaattgagaggtcattgtcagcagaccttcccctgtaagaaaaactaaagttgttcttcacggagcaggaaaatgatctatgtcagaaacttggatgcacaaaaggaaaggaaaagtgtcagggaatgaagtacaagtaaagtaaaatgttttgtttttcttattcttaattgattgaaaagataattatttaaggtaataagagtgacaatgtattggtgattgtattcatatggacaaataaaatgaatgacagtaatgtcataagagatgagagggaaaattggaaatagtctgttatagggtactttcactgcacatgaagaggaagaaatattaactgtacatgtatatggcaatccatagggcaactacttaaaaaattgaaaagcgtaattgatatgctaaaagaagagataaaatggaatcatataaaaccagaaaatgcagaaaaagagattttaaaaaagaactggtacaatgaatagaaaacggttacaaacagtaaatattgattcgacaatatcaataatcactttaagtgagaatggtctaaatgtaccaattaaaagattgtcagagtggctaaaaaacaagattcgactattgtatttgaatacagatgtgattcccagtctattttcaggcaagttctcaccactgtttgttatttggtttcctgtcattaaaaaaagttgactaacttccctactaactggcatattcagacagtaaagagcttaaaggagaggggctttgagcagaatggtggcatcctgatataagagagtaagagcagggagctaggagatgcatgaaactgcagcaaagtaacctcagcctctgaattcaagtgcccttcaaggaactgaactcatttaaccatactatcatatttgggaagcagggattattacttccatttcacattttgtgaaaactgttaagtatcttctgtgtactccagacaagacatccaggctccaggcctctcttacatggtccagcacttatttcatggaatcctctctactttgcccttctgtattcgctagtgcccactcccttgtcctctgccaattccatcgtggttctataggaaaatgggatgtctgtcattctctgcagctgtgaactttgcatatttctttggctttaaaatatctggcctgtagtgataaggattcagcaagccactgaaaagcaatggcacttaagaaaatctccggcaactctgtcttttcctcttgctttctcggtcctgctcaaagttgtcttgttggcaggcagccacctgtgaaatgtgcacatttcaaagcaaatggctccaggagctcataattgctgccaaacgtgtgtggattttaatagcccattttcattagccttgtgtgaaatcacctgtctctgtgttgttacccaacttaattgtcaattatggtgattaagcttggctttcactaccatcactggtaatcattagtattatctctgaggctgaacgaagggaaaaaaatcatgccagaaaaaaatatcattttgtaggtgaaggtgaatattttggtgtcaatgcatgaggagaatggcattttttttttaatttgggctgaaccaaacttgagtctacctgttatttccaacctgccttttagatgtgttaggacaaacgcttctcttttgtcacttggttttctctcaccaaagaagtgttcctgatgcctatccctttgcaattctcctgagatgagcataggtaattaagacagtaagttagataattaatgcctttaaaatgctttcagcaatgtcggtgattccaagtgtaataggtggagccctagaaaaacttgggagatagcacagaaagtgctgccaatgtacaacttgagattttgattgatgttctttctgctttcatcagtctcgttaaattttaagcaccttaccttgccttcttgactacagggtcatctaattttgcatcttgactaatattttactttttcgtggaatttgcaatgaacaataatgaaaatcaacgacattatcattatcatccttttcctccttctttacaaattttaatttagtaaaatcccaaactcatttctgttatgcttttatgggatttcaggacatggcaaaataatgaaagacatttttgaaaatggtatcattagacatcatctctagtatttgagtgccatgtgtgtccccaaggtttatgacactcttaagacttgacagtttcctttatctttccaaaacccttggaggaaactaataagagtttttttttttaattctaacttaatgggaagaaagaaattaagtcatgcaagcttaagggatatgaagtgtgaatcagtgactgttgccttctggggtagaggaggaatgaggctctattccagatagtccttaatgaaaacacctaaaatccataacctagcaaagatcctctggcaagtctggactgaggctggcaagagttacaaatgaattagctggacagtttccctctcttcccactttcccattcccatttagtgttctttacagtgttttgtttttaaaggcctgattataacaaatgctgtcttcatcacttggtttccaaaacccctgtactcaagattacagagtgtcctcagaagcttcatggttgctcacccgtgaagagtggaggactggaatccaaactcttatggtgcttttgtaatttctgtaaatatatatttttcttgtaattaaaaaatgtatttttttaatttcccaaaaaggagaatataatttatcatttaggaatagaggaggaagacaaattacagctgaaacattttctcttttatgaagctttaaccaactcttcctcttccaagtccctaggacaaaataaattgccctttttcctgtgtttcccctttttcctgtgttctttattcttgtgtggattttagagtgaccacattttattatagttatttgttgtataatcccacatttttatccttaaattttggtcaagagaggtcttctttttcagctgctgtgtaattaagtttaagggtgacgaaggaaagagaaaattcaaacagccaagaactgtgaaggatgagccttttaaaggagagcttactgccttatggtgaactgattcaaatgctttggtaacgtggacatgctgttaagggctgagtggtttctttatcaaacagcattctgcaaattcatggagttcccacatagacttgcaaatgcttgtactttgtgatagaaatgtctctggaagagctgactttggtctaattgtaaacttttccatttctcttagtgtgtatgtatcccccattaggacagattgtatattgtattcattcttttccatatcctagcacaatgtctgacacaaagagaacagcaacaaatgtttgctaaatagacttacagtatcacacgctacccccataactccaaaaatcaattttgaaattaaaggagaaataatgttagatattcatgttcttcctttaaagtctgcacgtccaacatatattggaaacaatgaaacaagacataatgatgtcttttgatatcagaatctcaaactccagctgatccccacctctttttgttttcatagaacctatgacttctctcaagaagctagcaggacaagaaattgctgtttctagacccaccctttgcttctcctttgagcttatggatctgttattttctggttatttaaatttaaagctgcctttgagatttcagccctcagtatcaagagctcccaaaattttcctgcagaaattcctcaattcagctatctctgccagttggggtttctgaggaaatgaaccaaagccggcagtggttgctatggtgactgagtctccctggagtgaagtcaggggagcatccatttgaaggaatgggggagctacattctagaagaatgaccatctgctaagaatgaagtgatcccggagaaggggtggggttaggggaatcttaaggaatatggaaaaaattagaatagatactatgagagatgcatcagcaactcaacaagagatgagtaaagtgattgcctgaacagcagtgagagtccagcctaggaaagattgcatgtatcagagtggaccctgggagcacggctttctggttcttcacagaaattctcagcagcctgggagtggcagcagagaagaggacagaagaagtgaccatcgaattggcaaagaagaaacatgaaatatgtgtagatcatgcacacttgtgagacataaatacacttcagattatgaagaactacattcacagaagtttttgtttaaaacagtttgccacagaatgaacagaagtttgtttgtgtgaaactgaagtgtgatggaaagcaaaacctcttattatttgtgcaataatccccaaatcacagttactatgagggtacattttatgatttattagtagagacatagtacttgttacatagtctagctcagcaaattcttgtcttgatattttaaaaattattttctgtcatgcaggctagagtgcagtgacataatcagctcactgcaggcttgaactcttgggctcgagagattctcccacctcagcctcccaggtaactgggactacaggtgtgtgccaccacacctggataattttttttatagagtcagggtcttactatgctgcccagactgatcttgaactcttgggctcaagagatcctccagcctcagactcccaaaatgctggaattagttttaaaccactgtgcctggccatttatttatttatttatttatttatttatttatttatttagacagtctccctctgtcacccaggctggagtgcagtggcgcaatctcggctcactgcaacctctgcctcccgggttcaagtgattctcctgcctcagcctcccgagtagctgtgataacaggtgtgtgtcaccacgccaggctaattttttgtatttttagcagagatggggtttcaccatgttagcctggatggtctcaatcccctgacctcgtgatctgcctgcctcagcctcccaaaggtatttattttttaacctgttgatccactagttggtaagtcatttgaaggcaagaattacgccttattcattttttttgtccttcgaagcactgatataggatctcttgcatagtagtttcctaatacctgtttgttgccccagaataacgaattctcaaagttggaaaggaactcgaaagatcataagacaccatcccatatccaggaatgaatttcctcccaaacctccagggtaaatggtgttccacctctccatggtgcctccagtgatagggagcctgctgcctcccacagcagcccaccccacagttggacagctggtattgctggaaagtgttcctttgtaccgtgttgagatttcagccagcctagtgtgatagctcaagcctctaatcccaactactcaggaagttgaggtgggaggttggcttgaggcccggagtttcagatcaactggagcaacacagcaacactatgtctcaaaaaaaaaaaaaaaagaaaaaaaaaagaaaaagaaaaagaaaaagaaaaagaaaaaagaaaaagaagaaagaaaaagagaaagaaagaaaattgctttcctgtgatgtctactcatagtgccttttgctgctccacacatagttccttcatgagtccatctcacagcccttcaagtatttgaagcagctttcatgttatttgggatctaatattgtctattcctttaagtgttcttcaaataaatgtttttcaagatcctccatctcttctcttggggtctggttagccaaaatttctcataacatgcagagcctggaaagaaccccacacaacagtgaggcaaaaccaacacagagtagagctggacaaggcttctgttcatatacttacggacacttaacttttctggcagtggttcctctgacaccaatgtaactaatagtcaactgaagcacccatgttgtctcctgtaaaccactgtgcagtccaatcttactcattccagacttgtgcagctgggtttagaaaccaggtaaatggcattatatttatccttcttaattgattgtcctcatttatcagggctattgagatgcttttaaaagcctggttccatgaggaataatgttccttccctctggtgttattgtgaggattacgtgaaacaatgcatgcgaagcacctaaaataccatgcacatagtaggtactcaataaatagtagttcatgtgattatggccaaccaaatttgaattaaataatgaattctaagttctctgacacctctagtattctgggataacagaaacaaatattatttttcacagtaaacaagtaatttgggacacctgattctgttttattactcaacctaacatttttatttgttgcatgttttaaaaactctgcctgtaactaaaaaggagtagaaataagttaggtcacaaagcaaaacactccttatccttactcgacaagcatgttatccaagcgatctaaacagtaagatcatcagatgaatgactgtcaaaaggaaaagatttgctgagaaaatatagtcagaagcatccatcaaaaatggatgaagtggcaatttctacactgggagtaagactgataaatataaacaaaacatgatgccaaaaagatatgtttttgtatttagtgcaaatttgagttaacaaatgaaataatttgatatatgtagggatatcaaatgagttatacgtagctataaggagtgacttttagctggttgcattatttgggccctgaagttatcaagcctgtaatgtcaaatttcccaaagtgtagttcaaagactttatgcatcagaatcacctggggtgcttgtttaagatgattactaggtattgtcccaaaccactaaattataattactaaagattggacccaggaatctgaacattaacaagctttccaattgattctgatgtccacaaaaggttaagaacctctgcagtatagggtaacctggagagcaaagggtagttactgcttggaggaaagagagggaatttcaccacccctactgcagggacacgaatctactacatgccttgtcactcccttagaagctattaacttgaaagctaagtctctcccttgatctgccttacccattctggatcatagtacagatcatatagaaaaactgaggcctccacagccatgaaacctctgaaaagactcagcaagataacctacccaggagtaagctaattcctgagagatcagagaaggcctccaccattgccagcttcctatatccaaaaagcacctgaaggattaatgatcttgagtgcattggacttaacttcctgaatcacaactggggacagcactcctgctccatagcagttcactgctagctgtcatgtttgtaccatgtgactccacctttgtggctgactggaaggggaatggattcctacccaagctgtgacaatcagattttctctcctgaggttttagaattggatctgagagttagcaagttgattgctcagttggttagaaatagaacatgtaaatttgggatctctgtttactctgtggacaaaaaagcagaaaaaatgagttgcatgtagagataagaaggaagcaaatgggcagagaagcaaagacatgggaaccgttcctgcttctagcttcttctgcagatccagctgcactcttgcccttgggttctatgagagacccttgtatccttctaccaaatccttctttaccatattatactgattgaaggagcactctgttactttcagctagaaggatcctaattagctaactcctttttgccacgtccatttttcctttctcagcacccagtgaaatcctttcctgttacctacatttccactcacatctctgtgttctgtgcctttgactcaatttcccactgttgccttcccacccaaacttttcatggaatctgtcctgtgactgataaactcctctccatcagtaactcattgttctttctcctctggctttaattgaagtccagttctcctcagaggatagcagtaccctgtggccctctcaagaggagactgttcttttcatatgcttgctaatagagcaatcattgttcaggacagcaatgagatttctaaaactggttaggccaatcatgacttattctgtaggctgggtagaggctctcttccctgaggttaagaaatatccactgcatgtttatctgggaagaagtaggagattggctactgggctgaccatggtttatgtctgacatgtctcctgctaccgccttccccccatcacatacacccatgagagtgtgcacacacacacgcacacacaggcacacacgggcacacatactccgttctccagccacagtggagattctttcacctttggacttgtccatatgctgttcctattgactgataaccttttcaccttcttcttcaccagaccaatacctgtacactttttaggtctccctaaaatgtctcttgccctgggaagttttccctgacaacccctcctgagtcaagcacccttgctgtgttctttcattacagtgcatgtcccttatcttcatgtttatctatcttacaatagtactgtttaagtatcagtcttttctacagcatctttctcagcacacatggtagaaagaggacatgctgccttccttatctttgcattcccagtagctgtaacagtaccaggtcaacaatggcaggaattttataagcatttgttgggtaaatgaacagtctccttctgagctgggcttagattttattaaccaccaggttttcataatttgaggacacattcaaaatcctgagaggtaaagagacctcagacagataacaaaatagatatgagaaattttgcagctacagaaatataatgcatcatttgacaacaagctgattgtagaatttaggcaatttcctgggtgagagtctgccttctgacctgaggcactgacagacccagccaatgtccaggcagtgtgacagaagctagcatggttgtgcttctctgggccatccagactgatgaacctccctccttgcttttctctacttttcctcctgtgtggatcttcatgtctaggggctggggaatgcagacagcatgtctctctggtctttttagttttgttttctagtcttaatacccttcctctttccttcctcatttctcactacttacgccaagacaaacactagtgacttttctttcttttgtgtatgctagacaagaaatgaagtgtagttaaaacaggaagctttaggttagatactaccttagaatactatgaaaaatggaagaaaaagggagaaataagaggtaataaagataataacaagcaaatacctaaaattgtctagagagtgttgggaatcaaagttggcccttttcagagagaaaacagtcaattgctttcttaaattttcctttatactaatatttaataattatctctctcatgattcaagcagccaggtaacctgaaagagaaagattgccatgatatctcttacattattcttcatttttaaaacaaaagcaaaatccttatttaaatagccaacattaaacacagccatttaaaatgatacaacaggggcatggttccaagatggctgaataggaacagctccagtctacagctcctagcgtgagcaatgcagaagacaggtgatttctgcatttccaactgaggtaccgggttcatctcactggggcttgttggacagtgggtgcaggacagtgggtgcagctgaccgagtgtgagctgaagcatggagaggcatcacctcacccaggaagcacaaggggtcagggaattccctttcctagccaagggaagctgtgacagacggcatctgaaaaatcgggtcactcccaccctaatactgcgcttttccaatggtcttagcaaacggcacaccaggaaattataaccacgcctcgcgtggagggtaccacgcccacggagcctcgctcattgctagcacagcagcctgagatcgagctgtaaggtggcagcgaggctgagggaggggcgcctgccattgctgaggcttgagtaggtaaacaaagtggctgggaagctcgaacagcgtggagctcaccacagctcaaggaggcctgcctgcctctgtagactccaccactgggggcagggcatagctgaacaaaaggcagcagaaacctctgcagacttatatgtccctatctgacagctttgaagagagtagtggttctcccagcatggagtttgagatctgagaatggacagactgcctcctcaagtgggtccctaacccccaaagtagcctaactgggaggcaaccccccagtaggggcagactgacacctcacacagctgggtacccctctgagacgaagcttccagaagaatgatcaggcagcaacatttgctgttcagcaatattcgcagttctgcagcctccactgctgatacccaggcaaacagggtctggagtggacctccagcaaactccaacagacctgcagctgagggtcctgactgttagaaggaaaactaacaaacagaaaggacatccacatgaaactcccatctgtacatcaccatcatcaaagaccaaagatagataaaaccacaaagatggggaaaaaacagagcagaaaagctgaaaattctaaaaatcagagcgcctctcctccaaaggaacgcagctccttgccatcaatggaacaaagctggatggagaatgactttgagaagttgtgagaagaaggcttccgatgatcaaacttctctgagctaaagaaggaagttcgaacccattgcaaagaagctaaaaacattgaaaaaagattagacgaatggctaactagcataatcagtgtagagaagtccttaaaggacctgatggagctgaaaaccatggcaagagaactacgtgacaaatgcacaagcttcagtagccaaattgatcaactagaagaaagggtatcagtgactgaagatcaaatgaatgaaatgaagcaagaagagaagtttagagaaaaaagagtaaaaagaaatgaacaaagcctccaagaaatatgggactatgtgaaaagaccaaatccacgtctgatcagtgtacctgaaagtgacagggagaatggaaccaagttggaaaacactctgcaagatattatccaggagaatttccccaatctagcaagccaggccaacattcaaattcacgaaatacagagaacaccacaaagacactcctcgagaagagcaactccaagacacataattgtcacattcaccaaagtggaaatgaaggaacaaatgttaagggcagccagagagaaaggtcgggttacccacaaagcgaagcccaaaagactaacagcagatctctcggcagaaactatacaagtctgaagggagtgggggccaatattcaacattcttcaagaaaagaattttcaacccagaatttcatatccagccaaactaagcttcataagtgaaggagaaataaaatcctttacagacaagcaaatgctgacagattttgtcaccaccaggcctgccctagaagagctcctgaaggaagcactaaacatggaaaggaacaaccggtaccagccactacaaaaacatgccaaattgtaaagaccacctatgctaggaagaaactgcatcaactaacgagcaaaataaccagctaacatcataatgacaggatcaaattcacacgtaacaatattaaccttaaatgtaaatgggctaaatgcaaattggagaaagagtcaagacccatcagtgtgctgtattcaggaaacccatctcatgtgcagaggcacacataggctcaaaataaagggatggaggaagatctaccaagcaaacggaaaacaaaaaaaaagcaggagttgcaatcctagtctctgataaaacagacttcaaaccaacaaagatcaaaagagacaaaggccattacaaaatggtaaagggatcaattcaacaagaagagccaactatcctaaatatatatgcacccaatacaggagcacccagattcataaagcaagtctttagagacctacaaggagacttagcctcccacacaatagtaaagggagacattaacaacaccccactgtcaacattagacacatcaatgagacagaaagttaacaaggatatccaggaattcaactcagctctgcaccaagtggacctaatagacatctacagaactctccaccccaaatgaacagaatatacattcttctcagcaccacattgcacttattccaaaattgaccacatagttggaagcaaagcactactcagcaaatgtaaaagaacagaaattataagaaaccatctctcagaccacagtgcaatcaaactagaactcaggattaagaaactcactcaaaactgctcaactacatggaaactgaacaacctgctcctgaatgactactaagtgcataacaaaatgaaggcagaaataaagatgttctttgaaaccaatgagaacaaagacaacatatcagattctctgggacacatttaaagcagtgtgtagagggaaatttatagcactaaatgcccacaagagaaagcaggaaagatctaaaattgactccctaacatcacaattaaaagaactagagaagcaagagcaaacacattcaaaagctaacagaagacaagaaataactaagaccagagtagaactgaaggacatagagacacaaaaaaacccttcaaaaaaaatcagtgaatccaggagttggttttttgaaaagatcaacaaaactgatagaccgctagcaagactaataaagacgaaaagagagaagaatcaaatagacgcaataaaaaatgatacgggggatatcactactgatcccgcagaaatacaaactaccatcagagaatactataaacacctctacacaaactaactagaaaatctcgaagaaatggataaattccttgacacatacaccctcccaagactaaaccaggaagaagttgaatccctgaataaactaataacaggctctgaaattgaggcaataattaatagcttaccaaccaagaaaagttcaggatgagaggattcacagccaaattctaccagaggtacaaggaggagctgggaccattccttctgaaactattccaatcaatagaaacagaaggaatcctccctaactcattttatgaggccaggatcatcctgatacccaaagcctggcagagacacaagaaaaaaagagaattctagaccaatagccctcatgaacatcgacacaaaaatcctcaataaaatactggcaaactgaatccagcagcacatcaaaaagcttatccaccatgatcaagtgggctttatccctgggatgcaaggctggttcaacatatgcaaatcaattaatgtaatccagcataccaacagaaccaaagacaaaaaccacatgattatctcaatagatgcagaaaaggcctttgacacatcaacagcccttcatgctaaaaactctcaataaattaagtactgatgggacatatctcaaaataataagagctatttatgacaaaaccacagccaatatcacactgaatgggcaaaaactggaagcattccctttgaaaactggcacaagacagggatgccctctctcaccactcctattcaacatattgttggaagttctggccagggcaatgaggcaggagaaggaaataaagggtattcaattaggaaaagaggaagtcaaattgtccctgtttgcacatgacatgattgtatatctagaaaaccccatcatctcagcccaaaatctccttaagctgataagcaacttcagcaaagtctcaggatacaaaatcaatgtgcaaaaatcacaagcatttttatacaccaataacagacaaacagccaaatcatgagtgaactcccattcacaattgcttcaaagagaataaaatacctaggaatccaacttacaagggatgtgaaggatgtgaaggacctcttcaaggagaactacaaaccactgctcaatgaaataaaagaggacacaaacaaatggaagaacattccatgctcatgggtagtaagaatcaatattgtgaaaatggccatactgcccaaggtaatttatagattcaatgccatccccatcaagctaccaatgactttcttcacagaattggaaaaaactactttaaagttcatatggaaccaaaaaagagcccacgtcaccaagtcaatcctaagccaaaggaacaaagctggaggcatcacactacctgacttcaaactatactacaaggctacagtaaccaaaacagcatggtactagtaccaaaacagagatatagaccaatggaacagaacagagccctcagaaacaatatcacacatctacaaccatctgatctttgacaaacctgacaaaaacaagaaatggggaaagtattccctatttaacaaatggtgccgggaaaactggctagccatatatagaaagctgaaactggatcccttccttacacgttatacaaaaattaattcaagatggattaaagacttacatgttagacctaaaaccataaaaaccctaggagaaaacctaggcaataccattcaggacataggcatgggcaaggacttcatgtctaaaacaccaaaagcaatggcaacaaaagacaaaattgacaaatgggatctagataaactaaagagcttctgcacagcaaaagaaactaccatcagagtgaacaggcaaccaatagaatgggagaaaatttttgcaatctactcatctgacaaagggctaatatccagaatctacaatgaactcaagcaaatttacaagaaaaaaatgaacaaccccatcaaaaagtgggctagggatatgaacagacatttctcaaaagaagacatttatgtagccaaaagacacatgaaaaaatgctcatcatcgctggccattagagaaaatgcaaatcaaaaccacaatgagataccatctcacaccagttagaatggcgatcattaaaaagtcaggaaacaacaggtgctggagaggatgtgaagaaataggaacacttttacactgttggtgggactgcaaactggttcacccattgtggaagacagtgtggcgattcctcaagcatctggaactagaaatatcatttgacccagccatcccattactgggtatatacccaaaggattataaaacatgctgctataaagacacagggacacgtatgtttattgcggcactattcacaatatcaaagacttggaaccaacccaaacgtccaacagtgatagactggattaagaaaatgtggcacatatacaccatggaatactatgcagccataaaaaaggatgagttcacgtcgtttgtagggacatggatgaagctggaaaccatcattctcagcaaactatcgcaaggacaaaaaaccaaacacagcatgttctcactcataggtgggaactgaacaacgagaacacatggacacaggaaggggaacatcacacaccagggcccgtcgtggggtgaggggtggggggagggatagcattaggagatatacctaacgtaaatgacaagttaatgggtgcagcacaccaacacagcacatgtatacatatgtaacaaacctgcacgttgtgcacaggtaccctagaacttaaagtataataaaaaaaatcaccaaaaacaataaataaaatgatataacaaatgtatgaaaaatacaagattcaaagaagtcacttaggtaaaatcagcaatctttctcacattgttatttatgaatgttcaatccagccctgatttatatccttaggtttttgcaaaggttcctttctaactcatcttgagttcttatattgttaacactccctaaacatcttattgagacaaatcagggacttcaggctatcttaatatgaaaagctttacccatctgccacaacttccctcggtcatagccacaagtattctttaccctgcttaactgttaggactaaatctagaacctgcatcaccttccccttggctcaactgctgctgctgcggcttttacttattttcttacaaacaacataaagagaaaaagatcaatttttcatgttagctgtctgtgacagtagcatgaacctctgtgactttttcacgataagggggtcatattttatcctcctcagaaaaagaatagtagctactcttcttctaaaacagcttttcctcactgggaaacccttaagtttgcataaaacaaacaattttatgcaaagcttaaagttatgctttatgcatagtggttgctctataaggctgttgatgaaacaaagtccttccagttaaagaaaccatgtgcctgtcatataagacaagcatcaaacacacacacacacacacacacacacacgtgcaaattgaaaatttagcaatgctttataaggatactcagtaactccattttaccacaatcctccctgaaaaaagtcagatgaacactcatgtgccatgatgacataacctcatttcttttggtgtctaatgttatttttctccctaaaccccaaactgcagaaataccaaaggctgccagcaaaagaagtagttgagctgctgaatcaatgaatcctggatgcacccttggaaaactgtgattagctttctctgcaatcaggatcattcaggggagtagagtaaccacatggaaagttgccttcttccaactctcctacactgaacattttattcttggtgtctctacctcctgtgtgtatcacaggatgaggcagtggaatagttagttgatccccaggttttcctgtcacctgtacctgccttgtgggttgttaagctgagccaaattattccagaggaggtgaattccagaatttttttcaacaattcaatagagtttcaaaatttcagaatacagtcccaaattataggtagagtcattctttttctagtgacttatattcacatttgatattctaaactagtaactaaatctctcccctcttacatgtatatagagggaatatttaggcaaggagagagggatatcaacaacagcttaatatgtactgactactccatgtccaaagctccatttattgtctcaattaatccccagacacttctgtagattagatactataattatctccatcgtacagataaggaagctgaggtttaaaaagtcagtaatgtgcccaaggtcaaatagttattagaactgggataacctggaatctgacccttacttcattgccactcagctatttcaaagctcctggctggtacaaccaaagaggatatggccagaggcagggtgggaatcctggttctgtcccatcatgtttaggctctgcgaatggggaggagacttcttggccactgagagaagcttttgttcttttatctacagatcaaaaagaaataagaatatagaaaggtttctcacctacatacccaaggcccatagctttagtgacatcttgtaacttcactcactcctggcgagttgtggtagtaaaagtttattgttaattttgtgaggttttgtttctgtttgtttgttctgcagaaatcttatgcatggcactctgttcttcatgacacacgatctgctcttaaatccccttcttcgaatgagcagttcaaaggagtgtagtgactatttacattcataaactatatcagtgacagaagtggcatgaaaatgacccaatcctaaatccttatggaaatagtcttttctctcactttgtgggtcatgataagctagtacaatatggagggcaaggtagaaaagtgtgtttcaactccatacacactgctgcagaaaagcacatgccctgccaatggtactgattcactgccaagtcgcactattctgaaaggaatcaattgagttatcctgcatgcaatctttaaccagtccctcttcctttcatgcatacatattcatcacttttatcagaaaataatccattctggagaggcagctgctttctaaataaattgctgttccttagcagctgaatccaacaggctgtttttctcacttcggtgaatttgttctgacaacagtgcacgccagtcatttgctcttttcctttcatgatttggttttattattaatctattcattatgtttattggctctgtccattatttaagagcctcagtgcatatttacaagtacaataaaaagagacagcctcagccattgtagcatacaggctaataggcagtcaagacataaaatgatccttctctcttcacctctgactaaagctatgtggggctgttgggttgacaaaccaaatcaacatgctagtacaatatgacccagtcaaatagccagatgatgtaatcaagcaattggtttgctttatttttcctccatttaatcaaaatttaaggattgttctttttaaaaattactgacatataacccacataccataaaattcaccctttttaagtgagcaattcagtggtttttagaatattcacaaagttatgtagtcatcactactatataattccagaacattttcatcacccctaaaagaaatccatactattagcagtcacttgccttttcccttcctcctagcccctaacaaccatcaatctactttctatctctctggatttgcttattctggacattttacataaataaaatcatataatatgtggccttttatgtctgtcttctttcacctagcatagtgttttcaaggtccatccatgttttggcatgtaccagtactttaatcatttttatgcctgaataatgtcccttggtgtaggtgtactacattttatacattcatcagttaatggacatttgggttgcttccacttttggactattatgaataattctgctagaaacacttgtgcacaatttttttgtgaacatgtttcatttctcttgagtatcttcataggagtggaatttctgggtcataactctatatttaacattttgaggaactgccaaattgttccaaagtgtctgcaccattttacattcccaacagcaatgtacaaaatgtacaagagttgtaatttctccacatcttcaccaacacttgttattatcttgttagttataaccaccctagtagatgtgatgtgatatctcactgactgtattcataattacttttttccttatggctaatgatgttgtacagatttacatatgcttattgtccatctatatatctgctttagagaaatatttattcagctattttgtccatttttaaattgcgttatttgttctttaattgtgaattttaaggtatgtattcattcttatcacatatgtgattggaaaatattttctccattcctgtgggttgtcttcttgcttcttaatagtgttctttgtaacacaaaagctttcaatttttaggaagtctgatttatgcatttttttcttgattgtgctttgcttttgatgttatatttgagaatccattgtataatccaaggccatgatgatttacatctatattttattctaagagttgtatagttttcttatatctaggtccattttaaattaatttttgtatattatatgaaatttcatccattttaaattaatttttgtctattatatgaaattggatccattttaaattaatttttgtatattctgtgaaataggtgtcaaattttattctttcgcatgtggctattcagttgttccagcaacatttgttgaaaagactattctttcctcctttgaattatcttagtacccttgttgaaagtcaattgatcgtaaacgtatgaacttgtttctggattctcaattctattccatggattgactgatcgattggttgattgatttttgaacaagatcttgctctgtcacccaggctggagtgcagtggtacaatcacagctcattgcagcctcaaactcctgggctcaggcgatcctcctgccccagcctaggactagtagctaggactacaggcacacacccccacgcactgctaacattgatttaaatagcttgcttatcgtagctttgtaataagttttggaatcacaaagtgtgagctttccaatttgttcttctttttcagtatcatcttgggtccttcgctttttcatgtaaattttaggatcagcttgtcaatttctgcaaaaaagggaagcagctggtattttaataaaggtgttaaatctgtagttcaatttggataatactgccatcttaacaatattaattattccaatccataaacacagaatgtctttccatttatttatgtctttttaaatttatttcagtgacattcaagaacaatccaataatcattctttattgaaataaacaggtggttcagagacatagagagacatagaatgaattaatctccccctctctcattttccctgtctttcattgtttctcttgccctctcactctcattttctctcttggcttcattataaagcagcagaaaaacacattttaaaaatatttgaaagaaatcttattattaacaccacatttaaaaaaataagcataatcccagcagtagtcccagcactggttatttccaccagagacacaaacaacacatattctgtttcttgtatggcaattgcacttcactatagaaatacaaaccattttagatgtcaatatagtctaatggcaacattttatgttacaactggtgagcactagggcatagctagcagatgatctgcagcttttctctcaaattcacccaaatatggagtctatttactcaataccttctttatttatagaattccatgaatgtaaaacacacacacacacacacacacacacacacggcatatccctactaaaacagatgtttacaaaaacagaatctgttccctcaagaaggtaacaggctgggtgaggtggcttgtgcctgtaatcccagctgtttggaaggccaaggcaggaatgcttgaggctaggactcatctctacaaaaaatacaaaaattagccaggtgtgatagtgtgtgcctattgtcccagctactcaagaggctgaggtggaggactgcttgagcccaggagtttgaggttgcaatgaactatgatcatgccactgcactccagcctgagtaacagggcaacagagtgagaccctgtctctaaaacaaacaacaaaaaaagcaacagtttgtttagaaagagcctgtgcacatatgaaaccatttggtagtggtgtagcagggcccacagtaataatatcaaatggatggccaaggaagaccacaaatgagaggtaagacaaaggaatacttgtgtggtccctgcctaccacacactttccatctcatgcaaaaatgtccatctgagggtctctaattaagaaagacgttttaggcatcgtgaaaatgctctcttcccacttggtcttcttagggattgcgctttcccttctgggtcttcacgatcattgtttcaatgatgcccttcccagcatgttccgccaccattttcacctatagtcactgtcaatatccagcccttcattatccccaccacccaacttctcagctctttatggtggtttgtcggggcctcttggagttacgaaatccaacctgattcctattgattcatattagcaatacctcattgattctagtaaatgtcgccataaaaattacttcacatttttaccctatgtcttcactcttaatgaataatatgttctcccacttcagacagagatcataagcatgaatatttctacctaaatatatttcctacaagcagtttctcatcttcctgtttcagagtaaccattttaccttctcaaagcactaacccctcaatttgtaactctcctactttatcaggaagctagctgcaataaatacattcctactctcttgatatcttctctctctctctttctttctctctccccccatgagggctcatttcttttcatctccaaacaaaacaaaagaaaaataacaaacaactttctttcacacaggtacccattttggtcattgcctccttttcttcctcttttgtgtgcacatttttttttttagtatgcaattggatttcactttatcctctgtttacccatttacttctcaatatcatgcaatctggcatcaactcttaacattcaatttctcctcatcctttttgtcaaaccacatcccatgctccttctctgcctttctttctgctagaggttagcacagggtcctgcgcttttaagatttacagagaaattgtctctctggactgcttctgccccacacagaagtatgacactctgaaccccttctcatcttcagctttcctgaaattctcaatgaattctataataggcacttttccaaaatgtttcctactcttttcctctttgtgtccttagctgattcccctttatctccacagtgcatggactgttcatttatcgttctgcatgtccagcgcccattaaaaggacttctttcttgacttttgtttgatgatgtctttctgattatcaccaatactattgtgacaagggcatagaaatttatctgaaacctagtaaagcttgaaaattatgtctatctattttggattgcctgtttttaaagagatttattgcaatattttcttaaatttgacttatttcaacttacgaggctccaatagagaccaaattgagatgcaaatagagaagttccttgtcatttttcggaaattaaagtgttactatagcttcttgagtttcatgagttgacttctctttgaccctaaaccaaattaaaggtacatattaaaaataattttaacattctccttaagttcttactctcaaggcttatttagtaaaagtgtacatcagtgacatcaagtttcttcaatttctttgaataaagtcattgctgaacaaggggggctgtccacatttctcatttgtaatcttgttttttgtttttggtagagatggggttttaccatgttgcccaggctggtttcaaacttctgggctcaagtggtcctctaacctaggcttcccaaagtgctgggatgacaggcatgagccacagcacctggccctgtaatctgttaatttacgcagtattagttgagcataccaggagtagcttcggatgagaaatgacttttgaactgaatctgtgaaaatgtttactaggtgaaaaaagtctcagatgtagggaggaaagggcatgagaagacattcaaggaagaaggaacgagcactaacaaaggcagagaactatgaaaggatatcatgtttgagtgattgcaaagatttcaacgtggctggagtatagggtagaatagtggaaaattaggcaggaagcaagcataggctgtggttagactggaaaagtgcttgtgcatcaaacaggggagggagtagtggttgagagagggcccaagaaagactggcaattttctgttttttaacctgagtcatggttataggagtgtttgtttcatggtattttgtgtacttctgtattttgtgtacttctgtgtatatgtgttatagacaaaacatttttaataggaaaaaatagaaaactcattaatattctaacatatggtagctagacacacctagaaataaagcaactaaaacagttcttggcacatagaaaaagctatgagagtcaatattatcttttaaagacaatctttgtccgactcctggttcccagcttcctttcctaaacaactttaacagtgtcttccagaaatcttttaggcacttagaaacacccctctactctctctacactttgaattatcagggctaaagagctggcttgatcttctctatccatgcatacactcttgaattcagggtctgcaagtgattcaatgctgtatctccctcagttcttatcccaggactttttgcccagtaggagctcagcatatatttgtaaagggaataagtaacctcttcctgtttccactcaaactcaatatcaaagttagcacttgtatcataggctaatctaacagaggtgacaccttagtgcaagagagcgttaccagtagctgaatggacatattgcttcccattaaagaatggctagggagtggggcctggatggccaactagagcagctgagataggagactcccgctgaaaagaaccaaaacagcctgcgaatcctgcactggcaaccgaggtacgcaggttctgccatcaggactgactaggtggctggcatgacccacggacaggaggaaagagcagggtggtgcatcagcctacctgagagctgcatggggcaggggagcccctacccccagccaagggaggcagtaagtgagcatgttacctacccagcctgggaaaccgtgctttttccatggaactgtgcaacccatggattggaagatcccattggtgaacccatgccatcatggagccttgcagattctcaacggccacttggctggaatctgcctaagtctactgagttccctcaggggagaggcggccatcaccattgctgctgcctgctgtctaagctgtctgagctccatggaggagtggtggcagccaccaccgcagttgcctaagacaaaagagctccctgagggaggggcgaccaccaccactgctgctgcctgatgtctaagctatctgaactccctgggggagatgtggcagccaacattgcagctgctagctacctaagacactaagctccccggggagaagggtggcagccattactatagctccaggctgtgctttttcccctgctggagccacggtggctggatggcttggtcccaagaggtattccccacagcacagcacactggctgtggcagaccgtggccagactgcctatttaggccaggccctgacccatccctcctcactgggtggggtgtccctgcaggacctccaacaactccagacaggggctcagggacagaactctcatctgcctgggctggagtccataggggtaggggtggccatagtctctgtggaccagcagacttagtctttccttctgctacctctgaggtatctgggcagcccagacaagtgggtttccccacagtgcagcacactccctccactaagagatagccaaagtgctttgttaaatgggtcctgtttctgtgcccccctactgggtgagacctcacaacaggggtcaccaggagcattcatactggcatcaggttgatgtccctcgaggtcagagatcccagaggaaggagcaggcacccatctttgctttctccagcctcctggggtgacatctccaggcatgggagtgaaccagatgaatagggcctgaagtgaaccccaagcaaaccgcagcagccctacagaagagggtcttgactgttcaaagaaaaacaaacagaaagcaacaacaatagtatcaacaacaaaaaaaaagtacccacaaaaaccccatctaagggtcagcaacctcgaatatcaaaactagacaaactcataaaaatgagaaagaatcaatgaaaaaatgctgaaaattcaaaaggccagagtgcctcttctcttccaaattatcacaactcctctctagcaagggcacagaattggatggaggatgaaatggatgaatggaattgacagaagtaggcttcagaaggtgggtaataacaaacttcactgaggtaaaggagcatgttctaacccaatgcaaagaagctaagaaccataataaaaagttacaggagctgctaactagaataaccagtttagagaggaatacaaataacctgatgaagctgaaacacacagcacgagaactttgtgaagcacacacaaatatcaacagccaaatcgatcaagtggaagaacaaatgtcagagatcacagactatcttgctgaaataaggcaggcagacaaaattagagaataaatgaaaaggaacaaacaaaacctctaataactatgggactatgtaaaaaaccaaacctacaattgattggtgtacctgaaagacatgggaaaaatggaaccaagttggagaacatacttcaggatatcgtccaagagaaattccccaacaaagcaagacaggccaacattcaaattcagaaaatacagagaaccccactaagacactacatgggaagatcaaccccaagacaaataatcatcagattctccaaggttgaaatgagggaaaaaatgttaagggcagccagagagaaaggccaggtcacctacaaagaggagtccatcagactaacagtggatgtgtcagcagaaaccctacaagccagaagatagtgtgaaataatattctgtattcttaaagaaaagaatttccaacccagaatttcatatccagctaaactaagcttcataagtgaaggaaaaattaaatccttttcagacaagcaaatgctgagggaatttgtcaccactaggactgccttgctagagctcctaatggaaacactaaatatggaaatgaaaaactggtaccagcccattccttctgaaacgattccaatcaatagaaaaagagggaatcctccctaattcattttatgatgccagcatcatcctgataccaaaacctggcagagacacaataaaaaaagagaattttagaccaatatccctgatgaacatcgatgcaaaaatcctcaataaaatactggcaaactgaatccagcaccacatcaaaaagcttatccaccatgatcaagtgggcttcatccctgggatgcaagtctggttcaacatatgaaaatcagtaaaagtaacccagcatataaacagaaccaatgacaaaacccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagaagacatgattgtatatctagaaaaccccattgtctcagcccaaaatctccttacgctgataggcaacttcagcatagtctcaggatacaaaatcagtgcgcaaaaatcacaggcatttttatacaccaataacagacaaacagagagccaaatcatgagtgaactcccattcacaattgcttcaaagagaataaaatacctaggaatccaacttacaagggatgtgaaggacgtcttcaaggagaactacaaaccactgctcaaggaaataaaagaggatacaaatggaagaacattccatgctcatgggtaggaagaatcaatattgtgaaaatggccatactgcccaaggtaattcatagattcaatgccatccccatcaagctaccaatgactttcttcacagaattggaaaaaactactttaaagttcatatggaacctaagaagagcctgcattgccaagtcaatcctaggccaaaagaacaaagctgggggcatcacactacctgacttcaaactatactacaaggctacagtaaccaaaacagcatggtactattatcaaaacagagatatagaccaatggaacagaacagagccctcagaaataatgccgcatatccacaaccatctgatctttgacaaccctgacaaaaacaagaaatggggaaagaattccctatttagtaaatggtgctgggaaaactggctagccatgtgtagaaagctgaaactggatcccttccttacaccttatacaaaaatcaattcaagatggattaaagacttacatgttagacctaaaaccatgaaaaccctagaagaaaacctaggcaataccattcaggagataggcatgggcaaggacttcatgtctaaaacaccaaaagcaatggcaacaaaagacaaaattgacaaatgggatctagataaactaaagggcttctgcacagcaaaagaaactaccatcagagtgaacaggcaacctacaaaatgggagaaaatttttgcaatctactcatctgacaaagggctaatatccagaatcaacaatgaattcaaacaaatttacaagaaaaaaacaagcaaccccatcaaaaagtgggcaaaggatatgaacagacacttctcaaaagaagacgtttatgcagccaacagacacatgaaaaaatgctcatcatcactggccatcagagaaatgcaaatcaaaatcacaatgagataccatctcacaccagttagaatggcgatcattaaaaagtcagaaaacaacaggtgctggagaagatgtagagaaattggaactcttttacactgttggtgggactgtaaactagttcaaccattgtggaagacagtgtggtgattcctcagggatctagaactagaaataccatttgacccatccatcccattactgggtataaacccaaaggattataaatcattctgctataaagacacatgcacacgtatgtttattgcggcactattcacaatagcaaagacttggaaccaacccaaatgcccatcaatgatagactggataaagaaaatgtggcacatatacaccatggaatactatgcagccttaaaaaaggatgagttcatgtcctttgtagagacatggatgaagctagaaaccatcattctgagcagcttgacagaggaagagaaaaccaaacaccgcatgttctcactcataagtgggagttgaacaatgagaacacgtggacacagggaggggaacgtcacacactggggactgtgtgggggttggagggctaggggagggatagcattaggagaaatgcctaatgtagatgatgggttgatggtgcagcaaaccaccatggcacatgtacacgcacgtaacaaacctgcatgttctgcacatgtatcccagaacttaaagtataataataaaaaaaagacattcatggggccaacaaacatatgaaaaaaagctcaatatcaccgatcattacagaaatgcaaatcaaaaccacaatgagataccatctcatgccagcaagaatggcaattattaaaaagtcaagaaacaacagatgctgctgaggctgtggagaaataggaacgcttttccactgttggtgggaatgtatattagttcagccattgtggaatacagtgtggcggttcctcatggatcaataaccgaaatgccatttgacccaacaatcccactattgggtatatacccaaaggaatataaatcattatattataaagatacctgcacacatatatttactgcagcactattcacaatagcaaagacatggaaccaacccaaatacccatcaatgatagactggataaagaaaatgtggtacatagataccatggaatactatgcagccatagaaaggaataagatcataccctttgcagggacagggataaagctagaagccatcatcctcagcaaactaaaacaggaacagaaaaccaaacaccacttgttctcactcataagtgggagctgagcaatgagaacacatggacacagggaggggaacatcgtacaccagagcctgtcgggggggtgaggggagggagagcatcaggacaaacagctgatgcatgctgggcttaatacctagatgacgagttgataggtgcagcaaaccaccatggcacatgttcactatgtaaaaaacctgcactttctgcacatggatcccagaacttaaatttaaaaaaaaaaaaaagaatggctaaaaggtgacatatttccttattcctcctgcactccttttttctaaaccaaccctccaaacatatttggacataattctttgaaaaatctatccaatgtaaactgtgtagatctcttgccatctaatatttttggtatgaggttcatcttaaccttaatgtgtataatgtcagtaagaatccccaggcaaaagggcttaagggtactaagtctcattatgttagttttaccataaaactgttattgaggaggatatagaaataacaggatactttatgagagctgtgggcttcttgagctctctcatggctcctaatgagagcataatcacaaaattattatagggaatttttttcttcacccaataaaaatgacacatttttctgagcctgaactagaaaacaacttttgcacgtccctgctgtcatttacctgaacatggtgcaagcacttatttttggttcttaatgaaggcacggagcttctaattatttagggatgtgattaaatgagtctcccagtgacttggtgtcgcaggagaaatcttttaatttgtacgctcctatggctgatgtatcttgcaaacagtgactatttaacaatccccattgccgctcatttgcactgctactccaactcattgactttgaaagttttaacagtgcccaatgaaacttttaattgccactgattagcgtttaggtttccgaaggcaggctgttaggggacatggtttggttctgcaaagaactgactgcagaggtcttggatgaagatcatgtaaggaacagaattccctcatctcggtctttctcctacccactcttttgtcatgaaagctccatatctatttttgaagacctgcctgacttatttttttatctttatttcatctcagatgactgtaagaaattcacaaacaagaacagaaaagcaaagaacatcataatttcaacacaaattctgaaaatatgacttagggtttaaaaactttaacctttactttttcttgcccaagtctcattagccctgatttatctctccgtctattttggagtaaaacctaatctcaaaatttcaatggatttggcagctaatatcagaacatgacagtcactgcacctcccatgttaaaatcttgctatgtaatctacatttgacttggaataattgtgggtaatgaaactaaaagctgattttcaggaaattataggcaatattaacagagtagaaaataaattgaaaaagaggtggatcctgtgttttcctcaatcaaccaatagtgaagtgtcagattcagtagatatcttagcatcaaggaaagaagattagaaaaattacaaagacaaacatgtcaaaagtaaatttgggggccaggcatggtagcttatgcccataatcccagggctttgtgaggccaaggcaggaggtatcacttgctcccaggagttcaagaccagcctgggcaacatagcaagacccctatctttacaaaaaaaatttttttaattagctatgcatggtggcagccacctgtagttccagctactttggaggctgaggtgggaggacctcctgagctgaggagtttgaggctgcagtgagatatgatcaggccactgcactccaacctgggccacagagcgagactccatgtctaataaataaataaataaatgttggcaggacttttggatatggagaaatgaaaaaaaatgtttaagttctttctggtttggagaacttgattgattataaatatggacactgcactaatcattttgggggttctttcaattaaagaaaaagtattaaaaacattttaatagagacaggatttcaccatgttggccaggctggtcttgaactcctggcctgaaatgatctgctcacctcggcctcccaaagtgctgggattacaggtgtgagccactgcgtccaacctctttcaactttttatggtgatgtagtttccatcatctttttctgagtaatttgttttgttttgcatcctttctcctttaagagagctggaaatgatttaattaaaacatttgaggggaagttcggtatgatcatctgcaattattagtaaaaaatttaccatttttccatttgtcttttagttgcttcattagttaatttcaacgaatgcttagggaatcactgattatgtgtttgctgagcacagaaactgcctggttaccggtagtatttgcaggggtactgtttggaacagatctttctagtatttcaggccttgctctatcgatttggtgcaattagtagtgcgctttacaaatcagttgttggcctctaacccatcgtgtaccatatgcactttttcttttaaaccctcctagtttatgaaatgactttcactgtgccaggtgaatttttccaggctggagaccatctgtcatttctcctctttcacctcactttgacaattgtcttctactttacaaggaggggcacatctgttacccacaccaaatctaaatgagctcaccactgcctcagggtaccaaagagacaagttacagtattggcttaggcaaagtctcatttttaaggaacctcagtgtggctgtccttctcagtctttcccatatttctgttaaaggagaagcttgatacttgaaatgatgtcattttgacccatgtaaggtgttgtaaattcagatgtattacagataacagcagaagtgacaacagattttcttcgacaagatctcacttcttctactctctaacccagaacatggcatcagaaagaaagagcaaaggcaacaaggccttatttcattcttggaaagtctctatattttgcatatttatttatttctttatatatcttataataaaaaattagcagttggacaactgtcacagagatgcataatatgtttaaatatttttaagtcacttttttctgatttcgctgatgaatttgacaacgaaagctggctttgtcaattagattacatagtggatatttaccataaattgaatgaggtgggtatcaagtcatagattcaagactttgaaaaaagcatacaataaaataaaagcattttatcaagaaaacattgcattgcaaagatgtattaaaatgaacagtgatttgattttctgaactctttctgagtctaccgagcaaagtaagtacctttaagtggaagagtaacaggcataaataatggtagtttgacaattcttggtaaagcctttttgggatacttcccagaaaatgagaaagtgatttgactgtaatgaataggtaacaaatcaatttgtaaatcaggtggtttccaattctttgcttcaacaaaatttatgtagtagctgatatacttaaatattattgattatacaatactatgtgattttgtcagatagctcagaagaagttaaaagatttaagtgacagtggtgtggcaaaactgtttccattttcagctacttatttactcgagcttagttacttagcactgaaagtgacaaaaaaagtagaagaattgatgctaaattctatttcattctagcaataagtaatattggatatacgaactaactttttaatttctaaattgtatttatgtctttgccttgtttgcaattaaaaaaataatttcaacttttattttagattcagaaggtacatgtacaggtttattacatgggtatgctgggtgatgctgaggtttggggtatgaatgatcctgtcacccaggtagtgggcatagtacctaataagtagtgttccaacctttccaccccttcttctctcccccagctagtagtccccaatgtctattatttccatctttatgtctatgagtaatccaatgtttagctccctcttataagtgagaacatgcagtatttggttttctgttcttacttgaattcacttaggataatggcctcctgatgcatccatgttgctgcaaaggacatgattttattcttttttatggctgcatagtattccttagtttatatgtaccacatttatccaatcctatattgatgggcacctaggttgattccatgtctttgctattgtgaatagtgctgtgatgaacatacaagtgcatatgtctttttttgtggaataatttatttttctttgggtgtataccctgtagtgggattgctggctctaatgatagttctgtttttagatctttaagaaatcttccagctgctttccacagcagatgaactaatttacattcccaccaacagtgtgtaagtgttctcttttctccacagcctcaccaacttctgttattttttcactttttaataatagccttgctggctggtgtgagatagtatctcattgtgattctgatttgcatttctctgatgattactggtgttgagcattttttcatgtttgttagctgcttgtatgtcttcttttgagaattgtctgtccatgttttttgcccactgtttaatggagatacttctttttggcttgttaagttccttataaactctggatattatacttttgtcagatgcatcggttgcaaatattttctcccattctttgggttgtcagtttactctgttgataacttcttttgctgtgcgaagctctttagtttaattaggttctatttgtccatttttggttttggtgcaattgcttttgacaacttagtcataaattctttgtcaaggctgatgtccaaaggctatttcttctaagatttttatagcttgaggtcttacatttaaatcgttaatccatcttgagttaatttttgtatatagtgaaaagtagcaagtcccgtttcattcttctgcatatggctagccagttctcccggcaccatccattgaataggcagtcctttccccattgcttagttttgacagctttgtcaaagatcagatggttgtaggtatgcagctttacatctgagttctctattatatttcattggtctgtgtgtctgtttttgtgtcagtgcgatgctgctttcattattgtagccttactgtaaacttttttggctatccaggctcttttttgattccatgttacttttagaatagttttttaaatcctgtgagaaatgacattggtagtttaatagataatagtgttgaatttgtagatcgctttgggcagtatggccattttaacaatattgattctttcgatccatgagtagggaatgtttttccatttgtttgtatcatctgatttctttcaccagtgctttgtagttctcttctttgtagagatctttcatctccttgcttagatgtattcccagatattttttgtgaggctattgtgaacaggattgcatttttattttggctgtcagctggaatgttactggtgtatagaaatgctactgatttttatatgttggttttatatcctgaaactttactgaagttattcatcaggtctaggagccttttggcagagtctttaaggttttctaggcatagaatcatatcatcaatggccaggggcagtggctcatgcctgtaattccagtacttttggaggctgaggcaggccgatgacttggggtcaggagtttgagaccaccctggccaacatggtgaaaccccgtttccactaaaagtacaaaaattatccaggcatggtggcacacacctgtggtcccagctactcagaaggctgaggcaggagaatcacttgaacctgggagacagaggctgcagtgagccaagattgtgccactgcgctccaacctgggtgagagagcaagactttgtctcaaaaaaaaaaaaaaaaaaaaaatcctatcatcagtgaaatgaggtaatttggcatcttcttttctattttgatgacttttaattatttctcttgcctgatggctctagctaggacttccagtactatgtgaaataggagaagtaagagtgtcatccttgttttgaaatggataaattcctggaaacacagaacttcccaagattgaatcaggaaatcgaaaccttgaacagaccaataatgaggtctgaaattgaatcaaccataaaaaacctaccaaccgaaaaaagtgctggaccagatggattcacagctgaattaccagaagtacagagaagagctggtaccaattttattgaaactagtccaaaaaattaaagagaagggactcctccctgattctatgaagccagcatcactctgatatcaaaatctggcaaagacacaacagaaaaagaaaactacagtccaatatccccaatgaacatagattttaaaatcctcaacaaaatactagcaaaccaaatccagcagcacattaaaaagttaattcaccaccatcaagtaggccttattcctaggatgcaaggttggttcaacatatgcaaatccacagatgtaattcaccacatacagagaaattaaaagaaaaactatatgattatcaatagatacagagaaagcttttgataaaatccaacataagaaccctcaacaaactagtcagcgaaaaaaaccactatttttcaagatttaaagttaatttacatggttttgaccaattgtgtaccattattgtttgtgttaataactcaatccaggagaaatttttaatattcagagctttatgttaatgggaaattttaaatatttaatttcagtttattagttattatttataattttatattatataaattatttatttatttatttatttttgagacagagtcttgctctgtcacccaggctggagtgtagtggtgcaatctcggctcactgcaacctctgcctcccggattcaagcgattctcctgcctcagcctcctgagtagctgggactacaggcacccgccacaatgcctggctacttttttgtatttttaatagagatggggtttcaccacattagtcaggatggtctcaatatcctgacctcatgatccacccacctcggcctcccaaagcgctgggattacaggcatgagccaccacgcccagcctataattttatattataaaacatatacttggatacaattcttgaaacctacaataaaaaaattaaatgatgtaaatttctaactctttaagaagagcatgttcatgtagttttaaaaatgggtgatggtcttgttaaattatcatttagattccctaataaatttaaactagtgatatacgtatcttaattaaacatgtcaataggtattatagccacaaaaattatatttttgcagccttttaaagccataatgaaaaattttagctattatttaaaaatgtagatggtgtggtacatattttcaaaattatttaagggggaaaaatatatatatgaggaccactactcctttcctgaatatatatgtatctgtcatgatcatctttggctgagagaaaattatcttaagtaaattttaaagtagttctagtgagaactacctaaaattactagtgtatcactgagttgggagaggtgatatcaatcttggcttgatctctcataaacaacatgatccagaggtaattacctaatcttgctaagccttgcttcctacttcaaagagaaactagagggtattaatgagagatttcttcaacttcatgcccctgcctgccatcctcttgactacatcaacactccaagggacagtggtccttcctgtctaagactgactcctcctcctgtgctccaaatttcaccacttcttgtctttctcaggaactctgctcatcaattattcttccccctctctgttacctccaattatcacaactctagtgggtttttccactcagcatttagaaagcccaagtctgtgccatattaaaattggaaaaacggtgtggggaaggaggcactctcatgatttgttgcaggtagtttaaattggcatttcctttctgtaaggcaagttagtaataggaatcaaaggctttagaaatggatgtggaatttggtttgtcagtttgaactgttgaactgtatccttaggaaataatctagtatatgtgcttgtatgtatgcctattttacagggatgtccatcacagcaatattcatagtaggggaaaattagaagcagtttaaaaactcaacagcagttttgttgaactaattatcatatgtgccatttagagtcatggtgttgaaaaatttaattaaatgaggaaatgtttgcattagtggaaaaagtcagattgtacactgcagggtggtatatatatcttccagtagttattcctctctggatatggaataagaagatttttctctttgcattttactacattttatttactacaattaacatacactgctttgtttaacccttttaaatttatttctctctaactgacatacactaaagaaaagaaactggaagagcccagggtggtagtgatggaattggcattagcaggtgagaaatttcaacaaattcatagatgtgaggagttgtgatctagaataatctattttctggtccttttatatcaatagcattcaaaaatttttatttgcagaccacttaaataggtcaaaatacgtgacaccccatctatcccactttctgaagtaaaaagaacttgctgatagcagatttgaaaggatcaaagaaacatgctgccataaacatttttagcagcattatgaatcaagtattacttactttataagttataacacaaggctctagaaatttaaaaatcacctagaaattatacttacattgagtatatactgtaacttccttaaatggcagaaatgtatagataatgtatcatcaatgaagacttactgtactagctaatgattttggattacatatgtacttatttaacagtaaggaaatgggtagtacacacttctcattacttttaatattgaaaagttgctttcatatgaaacatatatacagataggaaaagtttaaacaaagtttatcagagtttcattttaaaaaaccgtatcacaaaaattccagaaattgcaatgttctccatgtcattgtttcttcagagtaatttgcaaggggttttcaaacatgtctgcagtcaaaattttttcactaaatttcttcagaaaatttgtcatacattttaattgtttttggtgaaaactttaaaaatttgtggtggcttgggattttcaagttcctatggggtgcagtttgtatctccaacccctgtggcattatatattccccgcatataaactgtagaacctaaataaataatagttgctctatcattgtaatgacagaaaaatagaacttgagttcttcctcgctgaaagaacctgtgtgtataactaggagttctttgaattaactgttatgtagaagataatgtttatgaaaggataaaaacatgttaactggaggttaatatatattatgaaaactcagtagtaattacagtgattatttagattattagatgcacaaaggttttttttttttcaggaaagagtattttatcactggcattttttacaattcctaacacacaacaataataaaaagcagatgcatgtccactaattttatcactgctttaaattatctgtagttaatatagcccctcactgcatatcaccaggttggaccattctcactgccacaaaaatatggaaattaacacattcaaacaaccaatggatcaaaaaagaaatcacaaggaatattagaaaataccttgagatgaaagagactgaaaacatgagattccaaaatttatgggatgcagcaaaagcaatgctaagagaaaaatttatagctgtaaatgaatacgcttaaaaagaagaaatatatcaaatcaataacctaactgtgcatctcaggaaactaagaaaaatagcaaactaaacccaaatctagcagaagggaggaaatattacccaaagtgatctataggttcaaagcagttcctatcaaaatcccaatggtatttttttcagaaatagaaaaaccagtcctgaaattcatgtcaaattgtgacgtgtcccaaatagccaaaacaatctggaaaaaacaacaaagttagaggactcatactttctcatttcaaaatttactacaaagctacagtaatcaagacagtgtgatcctggaataaggacagacatatggagcaatgcaataaaatagagagcctagaactaaatccttgcagatatggtcaaattatttttaataagtgttccaagaccatttaataggggggaagatgttttttccaataaatgatgttagaaaaactggatatctacatgcaaaataatgaagaccaactaacccttcgggtagttagaacaagaacaagaacaaacactcggtagccctcatagccttctcaatagtattcagaattgcaagctcaaatataactagccacatgcatattttaggaggaagaaaagctcacattaaaatgtgagctcctaaaaatgtgagatttactggtagagtttatcaaagacagagataactgtattaccccagaatgaactggtcaacataaattattttttaaacttaaaaaataaaaataaacaaaaaatatttttaaacttaaaactaatttaaaaatttaaaatttttattttaaatttctaatatttttctgaaagatcttctaaaatagtcttagatatttcactgctttctttaaaaaagtaggttaaatacaatttaataatttattgatagctaagaattatctttttggaaaaaaaatgtatccttttataatacagtgatctccataaccactgttgaggtgtggaaagtttggtcctttaatacatcttgaattaatttttgtataaggtgtaaggaagggatccagtttcagcttcgtacatatggttagccagttttcccagcaccatttattaaatagggaatcctttccccattgcttgtttttctcaggtttgtcaaagatcagatagttgtagatatgcggcattatttctgagggctctgttctgttccattgatctgtatctctgttttggtaacagtaccatgctgtttgggttactgtagccttgtagtatagtttgaagtcaggtagcgtgatgcctccagctttgttcttttggctgaggattgacttggcaatgcgggctcttcttaggttccatatgaactttaaagtagtttttcccaattctgtgaagaaagtcattggtagcttgatggggatggcattgaatctataaattaccttgggcagtatggccattttcacgatattgattcttcctacccatgagcatggaatgttcttccatttctttgtatcctcttttatttcactgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattggttttgtatcctgagactttgctgaagttgcttatcagcttgaggagattttgggctgagacgatggggttttctagatatacaatcatgtcatctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccaacgttagacctgaaaccataaaaaccctagaagaaaacctagacattaccattcgggacataggcatgggcaaggacttcatgtctaaaacaccaaaagcaatggcaacaaaagccaaaattgacaaatgggatctaattaaactaaagagcttctgcacagtgaaaagaaactaccatcagagtgaacaggcaacctacagaatgggagaaaatttttgcaacctgctcatctgacaaagggctaatatccagaatctacaatgtactcaaacaaatttacaagaaaaaaacaaacaaccccatcaaaaagtgggcaaaggacatgaacagacacttctcaaaagaagacatttatgcagccaaaaaatacaagaaaaaatgctcaccgtcactggccatcagagaaatgcaaatcaaaactacaatgagataccatttcacaccagttagaatggcgatctttaaaaagtcaggaaacaacaggtgctggagaggatgtggagaaataggaacacttttacactgttggtgggactgtaaactagttcaacaattgtggaagtcagtgtggcgattcctcagggatctagaactagaaataccatttgacccagtcatcccattactgggtatatacccaaaggactataaatcatgctgctataaacacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtactttgtagggacatggatgaaattggaaatcatcattctcagtaaactatcacaaggacaaaaaaccaaacacagcatgttctcactcataggtgggaactgaacaatgagaacacatggacacaggaaggggaacgtcacactctggggactgttgtggggtggggggagcggggagggacagcattaggagatatatctaatgctagatgacgagttaatgggtgcagcacaccagcatggcacatgtatacatatgtaacaaacctgcaggttgtgcacatgtaccctaaaacttaaagtataataataataaaataaaaataaaaaatatataaaaaagtttggtcctttgccgagtggctcatattgctctacattttgaaatagttgtcctcagtttttaaagtttttttgctcttactttgttgtcatgctgtcagctatcgctgtgtctgtgtgtgtactggcaaccagcagagttctgcatttcatgtcagctcttagcatcatttctttgttggtggggggggggggcgcgtggggtgactgtggtggtttggtaatttcattgtcttttttcttttttttttttttttgagacagggtctcgctctgtcgcccaggctggagtgcagtggcgtgatctcagctcactgcaagctccgcctcccgggttcacgccattctcctgcctcagcctcccgagtagctgggactacaggcgcctgccacaatgcccggctaattttttgtgttgtttgtaaagatggggtttcaccatgttagctaggatggtctcgatctcctgacctcatgatccgcccacctcggccacccaaagtgctgggattacaggcatgagccactgcgcccggcctcattgtctttttaaaaaatacttcttttctcaattttgttatggatatatgaggctgggaagctgatcaccagagaaataaaatgtaattgagattctatgatatttctgtttcttttttatcacaagaaaagtgattaaagaaatccagctgtgagtgggatgtacaatacatatacatggtacatatgtcttgtacatattatatatattgtatcttttatagcttgctacaaaaggggaaaaaacttgaggtacaccttagagaagctaaagaaacacagtgtcatgagtggaatgatttttctagtgatttccagatgtctttttaagggtaacattgacttgtcaggaataggcacaagctgtgtattctaacagagaccactgccgtagatgaggctgcaggggagatgcctatgctaggacacacacaatgtcagtcagaggatgattagagggaaggttccctctaatttttgtatgaataatgcagttgtaaggaagataagctggcattcaaatccagtcctatctgaccgctaggtttgagtgctttctacagaaacatgtgacctccacaaacaaaatgcacatcctacatgggccactgtttgctttctgggagttcagtcctgggctgagctgccaaacataaaaccttcttcctccaagagccacagaagtgtggccaagtctctttcttagtaatactatggttaaaaatgaatacacagtgttagtgacaaagctggtctcccaaaagatggggtctttttctgttcagtgtcatgaagccaatacacaaaactgaaaatgaattgtcaagcagttcgggcttcatttcatggccatggaatggagaagtgggaacacagctcatacatcaacttctcaacaagtgatgggtgaggaggttaaaatataggatttctctaatgaaggggttggatattaaaaacaaggagaggaatattcctttcttttccagaaatgtgtagtgaactttctggagctggactgctgcctttctttttgtccttttatggcttcttctggtcattgtcatgtaattgtcaactgtcatagcactgctgggagtgtcatttagcatggaaatgagattataatgaagcccgagatctttctgaagttgtttggtcagctatcttggttctagccagactcagctggtctggttacaaagggaactttctatcgaaggcatcctgtttcttaaagataagcagagttaggaaagggtagaaattcagctctgtcatgtagtaacaatagcaacatcagtgtggataacctaaactcaggggcaaagatgaccagcttggcttgcagcttggactgaaaaacaaaacaaacaaaagccctatttctatggcttcatctgatgagcttaaaagcaggaattacctcacctagttgttttgtctataaccctatatgtttttcctcattccgttgtacgcactgagaagctgggttaacattaagtcataacaaattcggtgacagtgaattttgagagacttactttcagataatttactgccaaattaacacagagcagttaatcacttttaatgtctcttttcatacatctactttcatcaaaaaggtcctttctgtttaattactctgacccaaatatttagaataaatattgctgccatcacagattcagtctagggaggaatttaatgggagtaaaaacactcacatgaaaaatagcattcagaaatacagaaggaaaaatatataagtaaatgtgatataatatttatttcactcagaaagatcactcaggcaatttgtatatatatcagggctctaaaaagtaattttcactgtaactcttggtcaaaacagccagtactatttgcttacatgataacaggattaggactaaccatacattatgaccttcgctgactgtacaactttgcaaatacaccattctggaagacacacaaagctacactttcacacaggacacccaaccaattttctgacaccaaatgggtgtcctgcaattcaattaaattccaacactctctacctggagttagcatcagatctcacaagttaagggctgtcccacaaatctacccccacttcagacgccaatctcaagcctagctataattcaggagttcccacaatcccctccttgggttcaataatttgctagaatagctcacagaactcagggaaactctttattgtatttctttggtggggggtgaggtgattgtggtggtttggtgttttcattgtctttttaaaaaatacttcttttctcaattttgttatatgagttatatatgttaactagtatattatgttaaccaatatattataaagaatacaactcaggaacagctagatggaagagatcatagggcaaggtatgcaggggagcttctccagtgtgccacccctgagcaccttgatgagttgaccaatgcagaagctcatcaagtctcattcgtcaagagtttttatagagcttgatcattagctccaccacctactttcaggaggttggtagatggaggtgaaaatttcaaccttctaatttcttaatctttctaacgaccattcccatcctgagtctatctttttcgcgtaaactctatgaccccacctaagtcatcttattagcataaactcaggtatgatcaaaactacgtcattatgagtaacaaaagacattcctatcactcaggaaattccggggttttaggagctctgtgctaggaatctgggacaaatatcaaatatatttcttattatgccacaaacatgttgacaggaaacttaaatagggaacccttttatagaagaggcaactcaagacaactcgaaaactggtgatgccctaaggaaagtcagaggagacttgattgctttcttacaaaaagtcacagcttttgacattttgcacaacctgattcaaagtttctggttcaattgtactgaattctagtcagttctcttcctccttctgctcctcctctttcttacttgatgcaattggacctagaaaaccttaggcctagaagacacttagaactaaatttgaatgttggctttaccacttactagttgtgtgctcttatgaagttctttaaattctttgatcctcaatttccttatctatatacagccctgcatttcttaacaacagggatgattctgagaaatgcattgttaggcgattgtgcgctatgataacatcatagagtataatcacacaaacccagaaggtatggcctactacacacctacgctatatgatatcatctgttgcttctaggctacaaccctgtacagcatgtcactgttatgaatactataggcagttatgacacaatagcattggtatatctaaacatatctaaacatagaaaaggtacagtaataatatggtatttaaaattaaaattcacctgtatagggcacttactataaatagaacttacaggactgcaagttgctctgggtgggtccctgagtgagtggtgaatgaatgtgaaggcctagtacattactgtacactattgtagacttcgtaaatactgtatacttgagctccactaaatttattaaaatttttttcttcaataataaattaaacttatcttactgtatcttttttactttataaattttaattttttaacttgttggcttttctgtaataacatagctgaacatgcaatatggctctacaaaaatttttatttatatccttattctacaagtttttttctattttagaaattttttatttttattttttactttttaaaattttttgttgaaaactaagacacagaacgtatcttgtcccactgggaggtcttcaggggcaataacacgcatgtagctgtcatctcctagaataacaatgccttcttctgaaatacctcctgaaggacctgcctgaagctgtgttacaataaccttttttcttttctttttttttttttttgaaacggagtcttgctctgtcgcccaggctggagtgcagtggcatgacttcggctcactgcaacctccacctcccgggttcaagcaattctcttcttcagcctcccgagtagctgggattataggcacacgccaccatgcctggctaatttttgtatttttagtagagatggggtttcaccatcttggccaggctggtcttgaactcctgaccccgtgatccacctgcctcggcctcccaaagtgctgggattacaggtatgagccactgcgcccggccacagtgacctttttttcataagtaaaaggagtacactctaaaataacagtaaaaaactatagtatagtaaatattatatataaagcagtaacatagtcatttgttaccattatcaagtattaggtactgttcataattgtatgtgttatgcttttatgtgactggcaatgcaggagatttgtttatatcatcaccacaaacatgagtaatgggttgtgctacaacattatgatggctacaacattacagatgatagaaacttctcagctccactataatcttatgggactactgtcttaaatgcagtccatcactgactgaaactatgtggtgcatcactatatattggggaaaataatagtatctacctcatagtattgttgttaggattaagtgatataaagcatatatgagtacacaaaggcatacagagtgatataatggactttggagaatcagaagtgggaggttggaagaggttctcaggataaaaaaaactacccattaggtacaatgtacactacttgggtgacaggtgcactaaaatcttcaaattcaccaccgtataattcatccatgccacaaaaaaccacttgtaccccaagagctattgaaataaaaatttaaaaatataaagtacttagcatgaagcctggtacatggtaggggcattataaatattaactattatttgtattattaacaaatatggataattaactttaccaatctatggttcttataagtgccattttagttaccttttcagattgattgctgacttctggaaactgagataagtatgatgagcacttgaggaggtcactgttctgtcctgatttgtaggatttacatgtagatggtcccaatgtcagtcagtaatacaaatttatagcagtacaagctacaaaaatcttgcttactgtgaattaatctttcttgcacatcttacttagtaatgatagttttccttgtcctgagtaaatatcagtcaatagccagattaattgcttctgcaattaattgctccccagatgttatggctctaccaaaaacaagttaaaaatatgttaattattttattgatacataatagatgtacatattttgagggtacatgtgacaatttaatacatccatatagtttgtaaagatcaaatcagtgtaattggaatacatgtgttcattttttatatacatcatatgcgtgctgtaacaaggtgctccgcaggctcatctcaggccaggaggctcattgctgagttttcacatgagacccaggtccagaaggctttgcaccgtggctcctttacaattctcggaaaagtgctcctgttacgtgcatgtggacagatcttgaccttggttgatgaacccagagtaagactgagggccagcttcagagaatagtccactcattaaagagttgaaacaaggctggtattcaagaaagcacactgaatattctagtttctcacacatcatagaaaaagaagttgatgaaaatataaagttggaaacaggacatttctagtttcaggaaaacaaaattgttgggtttgggtagttactaataatctctaaaaccaatatgactgacacctgtggcttgagaagctccaagagagtaagagaagggcgctgtaatggaacgtgatgattccccacattgtctctctaggttgcctcgctctctcccaggtcactgtcatcaccagtggccactttttcagttctgtgggcccctttttccattggtattaattctatcatcaaatttccacacctgtacttggctgtgggttgaaaattctcaggagagaatgtgattatttctgtgcccaaggtaggtattcaataactgtctattaataagttctgaaaatgagcaaacaaaaatcccttcctatagccttctaaaacccacagaaacatgaaattctttctctctttctctctcttggtaaaggggtgcatactgcaggaaacagtgggttaagctatatggaggaatttatagccaagacattctaaatacattcaactcagtcttattcatcatcaattgacaaagcagatgaaggtatctatctaagactaaatgacttctatctgtgcatctgtaaattccacaggaatccaaggatgaaaatggaagatgtggcctacttctgcatcacgagatcagagaattacagatgtgaccctcacttacaggtgaggcccactggtgaatctcccctccgtaccaggcaagttgaacaaaattagacaattcaagactaaaacagaaataaccaatttccactacagcaacatggaccctgaattcttggagtgaataaataggcaaataaaggaaataaaattcagtgcatgtaaatttcttggattttcaacctagaaagacagtgcaggcaattgtcacattccattgttgctcttctgttactctcttagagcttctcaagacataggtattggacatattcagttttaggaataattaactacctgtacccaacaaccttgttctcctaaaatcagtatctttggatactcgtgtaattattcaagattgctcaagaatccattctggggcagagtctgttgaataggtttataaatgatgataaggaaggagtacatagtgaagtctcagactccaagatatacaaatctccccagaaagaagacaccccagagaagagagacattatagaataatcctgagattcgtgtcaatgggcagagccttaagagatgttataatgtgtgtgaggaaaaagtaatgaatttatgagtaatctaaaacacatctataaaatgaaagactatcccttagattctgctcaagaaaaagacccagagtcattaaatgttgaccccagcatatgtaccaatattctgcatcaggcaaaaagacctagaaaatgaagaaaatcattaaggactatactggaaagcaagctttatactggtatatctctgtttgaaaagatttatgtagttcttgctgctatgcctcaaaaccaagtttgccataacttgaaaagatccagagagcacaagctcaaaataattggagatattgagaattataaaaagaattttttgtttaaggttagatttgtacttccaatatggaaatctaattagaagtaattaaatctatataaccataaatagtacaaataaagtgaacagagatttgcttattcaacaactttaaagacctgggacagggagatggtaatttttgaaactcataaaatgaatgcattagccaaagaggtaggtgtgacaggaaatagaaatgcatttcaaaacatttggacaaattttggctgatgcagttatcaatgactttgaaattgattcaactcctggaattaagatggcttcagaagaggcagtagaagtatttccttgacatttttgtgggcaggataattcagatgtggattgaccatatgctcaaatattcccaaacagctcatgagttataaaagtttgaaaactattgatataatcaaaatattacctttaatccattcagcataccactttttatccttcttccttttaatttcaaggaagttgaatacccagtacagtgaagacaaaccttcagtagtgaacgcttccctttgatcgatggccagaggtcaggactctccagcaattctgatgaatgtatgtaacttcttggttctttctctattgtttcatcttaaattctgcaaaggagatgatgcagatgagcaatgctgcagttccttctcatttgcattttactagctttatgacagtttccttcttgcatgatattacctaattacatccttcaaggaagcactaacataccactctccactttcaattactcactccaacgaaggaaatcatgaaacacccatcccttctcagaaaattcacccagcaactgggtcactgtgggacaaagatcgtgtgaaggagtggaactacaatctcagtcaggaggtcctaagacaagccaagctctggccctgtttcccttcaagccaacttcctaggcatacaataatacaagtctcagacccatatatgcccagatggtactacccaacttactgctcatgtacttcaatgaatttgttccaaaaacagcttatttcaaataactttgggatgtttccaaaaatcatccatttacaagaaatcatcttttcccaatacttcaaaaaaaaaaaagggctgtaatctctgaaaacctttggaaagagaaaatccagactaatgttgagcagcttgtgttgcagttggtgtgtagcttcctaggggtttgctacaccttttacatatggatgatcaggcctatgtaaacttgtgaagatgtgtctttgatgcctgattttccttccttgactcacttttatttttttttaaagttctggggtacatgtgcaggatgtggaggtttgttatgtacataggtaaacatgtgtcatggtggtttgctgcacctatcaaaccatcacctaggtattaagtccagcatgcatgagctatttttcctgatgctttccctccaccttccccatcactgccctacaagccccagtgtatattgttcccctctatgtgtccatgtgttctcactgttcagcttccacttataagtgagaacaaatggtatttggttttctgttcctgtgttagtttgctgggcataatggcttccagttccatccatgtccctgcaaaggaaatgatctcattcctgtttatggctacatagtatcccatggtatatatgtaccacattttctttatccagtctatcattaatgggcattttggttgattccatgtatttgctattgtgaacagtgatgcaatgaacctacaagtgggtttactaggtcatatggtaggtatgtgtttaactttttaagctgccgccaaactgttttctaaagagatttgttattttacattcctaataacaacatatgaaagtttcagttgttccatatctttggcaacacttggtttggccctttaaattttagccattctagaggaagtttactggtatcttattttagttttaatttgtgtgaccctaatgaataatgatgttgagcatatttcatatacttatttgctacttatacatcttctttggtgaaatgtctgttcaaatttaactatttttaaatttggttgtcttatagttgaactgtacatttttttgtactagatacaagtccttttttggatatctgttagcagatattttctcccaatctgtggctttgcttttcacttccattagagtatcttcttgaagagcaaaagtttttaaattttgatgatggcaaatatatgagtattttctatctcatgcttttagtgtcttatctatgaaatctttgcctcaccaatgtcattaaaatttctcctatatttttgtagaactttaatagttttagattttatatttaggtctatgattgattacaagactatgtagtacacagaaatttcattagctattctaggtttttcaaatttccacataaattttagtatcaaattgtcatcttttttaaaaaaaagagaaaaaccctgctattattttgaatggtattatatagaatctatagaacaatttggagataagtaacatgttaatatggagtcttcctatacatgaacaaattcccagctttgtttttttaaaatagtttctgctattctgagtcttttgagttttcacagaatttttagaatctgcttgtttgtctccacacaaaatctactggaattttgaatggcaccaaacccatagatcaatttggaaaaaattgccatcttaaacaatattgagttttccaatccaaaaacattgaaagtttgtacatttacttagagttaaaaaattatctctacaaggtcttttttttttcttttttcaacttttattttagaatcaggaagtacatgtgcaggtttgttattatacgaaggtatattgcatgatgctgactctacaatgttttgaaactttccatgtacaagacttgcataccgtctattaaatgtattcctacatgtggtattctttttaatgcttttataaattcataattcccttttcagattgtttatagcaggtagacagaaatacaactgatttttgtatattgatcacatatcttgtgaccttgctaaattcccttattaattctaggatttgttttgttgttattgttgtttcttgcgtagactccctagggttttctacatggaccactgtgtcatctgcacataggtataattgtttttttttttccttttgatccatatgtcttttctttccttttattttctttttgcatgggctacaacctcccatagaggttagaatgaatcgaagaggttagagtgaacatccttgccttttacccaatcttagatggaaagtcttcagccttttatcattaagactgatgtttgccataggtttttttgtagatggctttcaccagactgagaaagctatcttttattccaagtcttttgagattttttaaaatcataaataggtattgaattttgtcaaatatttttctgcatatattgaaattatcatgtggtttttgtcctatattattttaatatgatgtatttcattaattgttttttggatgttaaacagcgttgcactcctgggatgcatcttacctagtcatggtgtataattctttttcatattcttagatttcattttctaatatttccatttatattcagaagagatgttggtctatagttttcttttcttgtaatatgcttatcttactttggtatgaggataatatggcctcatagaatgagttggaaactgttccttctgcctctatttcctggaagagcttgtggagcagcagtcttatgtctttgttaagtgtttgatggaattcacttgcaaagtcatgtaagtctgagtttgtatttgtgagaaggttttaactacaaatttctttacagattttggatctattcagatgtttcatttcttcttgagttagttttggtagtttatggggttttttaagaatttgactatttcacctaagttgtctaatttgttggcataaagttcctcataatattcccttatgatgcttttcatttaatttgaaatattctttttcttttctaatataggcatttaaagtcatatgaatttttctctgtgttgctttagctgcatcccataaattgtaatatgtgtggttttcatagtgattcaatttaaaatactttctaaatttttggtaatttctcctgattcattcataatataattcattcagaaatatattgcttaatttccaaatatttgtggagtttccaaatttcattttgttgttggtttctaatttaattccattgtggctggggaacatactttgtattatttaaatactttcatggaaagggacaaaatggctgactagacacagccaggaaatgcctctcccacaaagagaatccaggatttcaagtaaaacatcatagttcaaacagatcatttgagagaaaacacaaaaagttgatagagaggtgacagagacactgagggtgaagaaggaggaagctaggcgcctgcatggagtcactcagagtgacaagaccagctcctgatcctgagcaggtcctagggaagcagtgagtgaaggaactcccaggcaccacactcccgccacacacctctgggatccagactacaagagatcccatgacccccacaggcatttgaactgatagaggaaactgccttgaagcagaactggaacctgcatggagtccagagctacagcaaaaatgtgagcataggctcccattccccaaggctctccattttgttctgtgtggctctagcccctgctgactgccgggctgggagagagcagagctacctttcccgtgggacaggggcacatctgatacacatggcccttgtacaccagctcctcccaaggccacatgcctggctgctcctgcaacagggagcacagagcacagcctccagcctccactgctccacctgagtatttttgccaatcgcctggcagcagtttggctccccggaacacagccagtgctcaaccccaagaggccagagggcaaagccatgggcctggtccccaacccccagggattgtgcacactgcccaggggcatcaagctgagatctgtgacctgacctcaagcaagggaaaagcctccactctcagaacactgagaagagtgaggcgtgagtttgtgggcatgtgctggcgtgggacttgagcatctcttcctatgcaaagctggcctgggaagagcctagcctgttgaccagctgcagcttctgcccaagagggccccaaggcttggaacacctggaacaacccagcgatctggatgcagaatgcttgagacaaatctagctggtcaggcctcctcctggggcaaacatctgagggaggctcagttgggggactgcaagctcagtagaccccatagccatctcctgggcaaaaataaaaaacccaggccgtggacgccacaccagctgcacactcgtggcactaccaccctgcccagggatcctccgcccatgatccactgcatcaccaggccaacgcagacatagcccacaaccctctctggctctgccaaacacagagaatcagcaggttccctggagtggtgggtctcttgttgacccaacctgtggatctgactgcccctaacggaggtgggagtgcaggccaccaggacccccactggaactaaggaacatagacacagtgctagtgattggaggggggtccctcaaggcccaggagcagataccacgagggagacatctcttgccctcccctctccctcttcccctaagcactgctgctaatgcacatagctaacagcatatctgctggctcttactcttaagtgccatctactggatcatgacatgaattacaccaccaaccaaaagtaaatttgttgggcaggcaaagcctgtgaaacccagtgcaggaaactagccacaattaaggaatgcccacagaccctttaccctttgaaagcacccagaaatgaagccaatcgactatacacaacatacaccacagtcaaaacctcaaggggaaaaaaagaatataaaaacaaaaagccccactcaatcaacagcaactttaaaaagacaaagagacaccagccctctcagatgagaaggaatcagtgcaagaactccagcaattcaaaaagtcagagtgtttccttacctacaaagtatcgccctagctccccaacaacgtgtcctaaccagactgacatttctgaaatgacagacatagaatttagaatctgaataacaaggaagctcaatgagattcaagagaaagttgaaacccaaactaagaaaggcagtaaaatgatccaagagttgaaagacaacatagctattttaaaaaagaatcaaactgagcctctgaaattgaaaaattcactacaggaatttcaaaatacaatggaaagccttaacaacagagcaaaccaagctgagaaaagaatttcatacctcaacaactcaaccagcaaaaaagaaaaaactccattaaatagtgggcaaaggatatgaacagatacttctcaaaagaagacataaaagtggccaaaaaacatatgaaaaaatgctcaacatcagtaatcatcagagaaatgcaaatcaaaaccacaacaaggtaccatctcacactagtcagaatggctattattaaaaagccaaaaagtaacaaatgctggtgaggctgtggagaaaagaggatgcttatacactgttggtgggaatgtaaattagtttgtcctctgtgaaaagcagtttgaagatttctcaaaaaacttaaaaaaaaacaaaaaacaaaaaacgaccacttaacccagcaatcccattattggttatatacccaaaagaaaataaatcattctacaaaaaaaagacacatgcacttggatgttcgtcacatcactttacaatagcaaagacatggaatcaacgtaggtacccatccgtggaggattggataaaaaaaatatggtacatacacaccacggaatactacacagccataaaaaagaatgaaatcctgtccttagcagcaaaaaggatgcaactgtaggtcatcatcctaagtgaattaacacagaaacagaagaccaaacactgcatgttctaagtgagcactaaacactgggactcatggacataaagatgggaataatagacactggagactactacagtcgggaggtaagaagggaggcaagagttgaaaaactatcggatactatggtcattacctgagtgtttgctatgggtattgcatgaaatctgtgtcttaatctaaatctaaaaagttcagattaatatcaacttaattcccattataaactcattaacacaaatttgtaagtattgttttatctttaaaacattttttatttgattttttttggggggggagcagtggggatggaggcttactttgtcacccaggctggagtgatgagatcaatcatacaccaaacctcagcatcatagaatatgcccgtgtaacaaacctgcacatgtaccccttgaatctaaagtaaatgctgaaattttttttaaaataaaaataaataaaccctttaaattcattattgctttgtggtccagtatgtgatctatgctggagaatattccacatgtgcttgaaaagaatgtgtattctactgttggatggagtatttgatagaggtctgttagatgaagttggttaatagtgtcttaaagtcttttatatctttgctggttttctgtctattctatccattattgacagtggagtattgaaacatccaattattattgtattatctatttcacccttcaattttgtcagtttttgtttcatatctttggatctttgttcttaaatgcatatatgtttgtaataattaaagcctccttctgaattgacctttatgtcattacaaaatctccctctttgtccgaagtaagcttttttgtctcaaagtgtatttttttctgatattaatatggtcattccagctcctttactgcttgcacagtgtatattttccatccttttactttcaatgtatttgtatttttgaattgaaagtatgtcttttaaagaaacacttatcatatcattggatcctgcctttttttttttttgaggtggagtctcactgtcacccaggctggagtgcagtggcatgatctcggctcactgcagcctctgcctcctgggttcaactgatttctcctgcctcagcctcccaagtagctgaaattacaggcacccactatcatgcccagctaatttttgtatttttagtagagacagggtttcaccatgttggccaggctggtctcaaactcctcacctcaggtgatctgcctgacttggcctcccaaagtgctgggattacaggcgtgagccactgtgcctggcctggatcctgctttttaatccaatctgaatccctgccttttatttgtagtgtttaatccacctacgtttaatgtagttattgaaataataggagttacatctgctgttttgcaatttgttttctatatattttatgtatttttgttcctctactactgctatcttttatgttatatagagattttcaattgtagcatttaaactcccttattagttttttattgttttggtgactcatgtttaaacacagactttaagccgggtgtggtggctcacccctgtaatcccagcactttgggaggccaaggcaggcagatttcttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccccactacgcccggctaattttttgtatttttagtagagacggggtttcaccgttttagccgggatggtctcgatctcctgacctcgtgatccgcccgccttggcctcccaaagtgctgggattacaggcgtgagccaccgtgcccggccaaggcaggcagatttcttgaggccagtagtttgagaccagcttggccaacatggcaaaatcctgtctctactaaaaatataaaagttagccaggcacggcagcacatgcctgtaatgccagctgctcaggaggctgaggtaggagaatcacttaaacccgggaggcagagattgcagtgcgccgagatcatgccactgcactccagcctgggtgacagaataagactccatcctgaaataaataaataaaaatagactttattttttagagcatttttaggtttacagcaaaattgtacagaaggtacagagatttcccatatactaatgtttttctactatatattttaaagtatttttaagtgtttgcaatgggtattgcatgaaatctgtgtcttaatctaaacctaaaaggttcagattaatattaattccagtagtttataaaaactttgcttctatataactcccttcccattataaactcattaacacaaatttgtaagtattattttatctttaaaacatttttttatttgatttttttttgggcagtggggatggaggcttactttgtcacccaggctggagtgcagtgacacgatctcggctcactgcaacctccgcctcctgggttcaagcgattcttctgcctcagcctcccaagtaggtgggattacaggtgcacaccactccgcctggctaatttttgtatttttagtagagatggggtttcaccatgttggccaggctggtcttgaactcctcacctcaggtgatccatctgccttggcctcccaaagtgctgggattacagatgtgagccactgcgcccagccataagtattattttaaacagtagtctttaaaatcagttaagagaagaaaaaatttaaaatataagttggtaatgacttttatatttactccacttaattacttttacttgtgttctttaattttttcatgtacttttggattactctctaatgttctttctttcaagcctgaggtaataccctttagtatttcttatagggcaggactgctggtagttcattatttgttattgctgagtagtattccatgatggatgtaccatagtttgtttaactattcattaactggaggacatactgattgtttccagtttggggctatataataaaatgttatatatatatagttatataaaatatagcttatataccactatataatttattatatgtaataatgctcatctgaacaatcatgtacaagctttagtatggatgtcaacatttatttctcagggataaatggcctggtgaaaagttgatggattgtatagcagatgcacatttagtttgtaaagaaactatcaaacgatttcccagagtacttgtattattttatattcccattagcattgtgacagagacccagtttctccatgtccttgccaatatttagtactatttatctttatttgagctattctaatgattatgttgtatctcatcatggtcttctgttgcttttccctaatggctagtgatactgaatatcattgttatctatataacttattttatgaaatgtctccttgtgtatattgacaattttctaatttgattttttattgttaagtttgagagttctttataattctagatgagtcctctgtcagatatatggtttgaaaatattttctccagatctgtatcttgtttttttgtcctctgatcttccacagagaaaaagttttaaattttggtgatgtcaatttactatttttttccttttatggatcaagcctttggcattatgtctaaaatgtgttcaccaaatcactggtccacaaaatttactcctatgcttttccataaaagttttatagttttatggtttaagtttaaatatatgatgcattttgagttaattttagtataaactgtaaggttgaggtttagtttttttaatatggatatctaaattcttcatcaccatttacttgaaagactaaattgattttacactttcatcttaaattagttacccatgccgcattgagtctacttctaggttgtttattctgttccattgatccaagtgtcttatccttacactaatactacacagtcttgttgtaaggtacagtactttttcccattttatttttttaaaacataattgctttagctattctagttcctttaccttttcatttaaattttggaataatcttgtctatatctgttaaaaaatcttactgggattttgatggaaaatgtattaaacctgtaaatatcaatttggagagaactgatatgactatattaatcaatccatgaacacatatgctcttccacttatttttagatcttctttgatttctttcatgagcattttgtagttttcagtgtgcaagttgtgtgtatgtcccattacatttatacctaagcattttttttaacaattgtaaatggtattgtatttaaaatttttggtttccacatgatgcaagatagctgagccccacaactggggcttagcccgggagggttcttagcttaaccctggaaataattcaagggcaagctggtggtgtcaggcatcaatttttattgaagcagcagtgtacaccagcagtagaggtactactccttgcagggcagggctgcccaacaggcagtgagccctgagtagtagctcagggcagttctgccatcacatttatatccacttttaattatatgcaaattaggcagattatgaaaatttttaagaaaaatggtggtaacttccaggtgttcccatgccactggtaaacaggtggcacactggtgggcatgtcttaggggaaggtgctcccaccccatccctgttttagttagtcctcaatttgctctggtgtctgagccccacttccagagttgaatcccacctccaaaatcaagtcctgtctcctacttcacactttctcattaatagaatatacatgtacagttgatattttgtttgctaacctgtgaccttgctgtactcatttactggttctatgattttttttgtaggcatcttagcattttccacatagaccattatatcatctgcaaataagaacagttttatttcttttttcctgatctacctgcctttaaaaaattttcctgccttattgcactgcctagaacttacagcactacactgaattaagagtagtcagagcagacatccttgtcttgttcctgatcttttaccactaaatgcaatgttagatgtgggtttttcttgcagactccctttatcaagttgagaacaaccccctctattcctatttttctaagagttttgccatggttgtgtattggatttcgtcaaatgctttttctgcattgataataccattcggatgtttggcccctccaaatcttatggtgaaatgtaatccccagggttggaggtgggccctgctgggaggtgtttgggtcatgggggcacatccttcatgaatggcttgggctatcctcatgatagtgggtgagttcacaagagatctggttgtttaaaagtgtgtggcactacctgtctctctctcttgctcccactctcatcacatgatgtactggctccccctttttctttcactgtgattggaagcttcctgaagccctcaccagaagcagatgccagtactatgcttcaggtacagactacagagctatgatccaattaaacctctcttctttataaattacccagcctcaggcatttatttacagtaacacaaaaaatgatgtaatacaattaattaatataatcatgtgacttttcttctttagcctattaatatgccaaatcacattaattagttcttaatattgaaccagtcttgcattcctggaataaatcccatatggtagtggtgtataattcttattacatattgctgaattctatatgctgattggttaagaatttttgtacctacacttatgaataataatgatttatagttttccttccttttgatgtctttgtctaattttggtattggagtaatattcacttcataaaatgatttgggaagttttcctttttcttgtattttttggaagagattatgtaaaattgatgttaattctttaaaagtttggtggaattctccagtggacccatctgggcctggaagtttcttatactgaatttttaaaatgaaaaagttgattttcttaatagttatggatagggctattcaaattatctattttatattaggtaagttgtgacagtttgtgcttttcaagaaattggtccatttcatctaagttgtcaagtttacatgtgtagaattatttgttgtattttcttactatccatttgatattggcagggtctctaacgatatcccctgttcatactgatatcagtatttgtgtcatctctctttgtcagtcttaccagatgtctatcaatcttactgatattttcaaagaaccagatttttttcataaattttctctattatttcctgttttcaatttcattgatttctgcatcattttccttccttctctccttgcttatttttctcttttttctatgtgtgtgtgtgcgtttgtgtgtgtgtgtacgtctgtgtgtggtgagagtttagactaagaattctaaactcttcctctttcttaatgtaatttagtgctttaaattttcctctcagcactgggttagctatattccaaaaattttgatatgttgtatttttattttcatcccattcaatgtacttatcaatttcccttaaggctctttctttcactcacggactatttaaaagttgtttggtttccaagtgtttggagacttaactgttatcttcctatactgatttctagtgtgattctattataatcagataatatactctgataattttaattcttatataatttttgatttgtcaatttttccttttagctccctcaacttttatttaacacgtttcaaagctctgttttttggtgtttatacatttagaattacttggtcttcttggtggattgactcttatcactaaagttcctctcaattctctgtttttaaatatgatattaatatacccactcctgctgtactttttttcaggcttttactttcagtatacctttattgttttatttaatgtaaatttcttgtagatatatatagttagtgggccattttgtggtttttggtggtgctggtggtggtttgttttttaaaatctaccaatctctgtcttctacttgacatgcttagaccatttacatgtaatacgcttattgatatattagggtttaggtctgctgttttatttttgtcgtctagaacaaatagctctttctgctgttcacttctctgtagtattttttccctgccttcctggaggttacctgaacatttaataaattctactttgatttatttgtagtcttttgagtttatctcaatggaatatttttaagtggctgttctaggtattatacagtctacctctataaacattttttcaattcaagggatgtgtagaaaatttacctccttttacatctttttactctctcccatttattaaatcatttattaaatatttgctctacatacactgagtgatacatgagacagtgttataattttgccttaatcataaaacttagaaaactccaggggaaaaggaaagtctattgtatttacccatatttatactcttttcattgctctttcttccttcctgatgtttcaacatttcttctttcatcatttcctttctcttcagagaagtgttgttttaaaagttttttaatagtagatcttccggtgacagtcttttggtgttccttcatctgagaatatcttaattttttcttcattcctaaagggttatttttgctggatctattcactggagttagagttacagttcttttctttctgcacttgaaaaatgttgtaccacttccttctggcctccatggtttctgatgagaaatccactatcagtgaagttttttttttccctcttgtcaagatatcattttctttcactactttcaagacttttttctctttcgttttccgtagtttgtctattgactcttggcatggatttcaatgagcttatcctactttggctttgcacatcttgattgataggtttatgtcttttgccagatttgagagattttcagctattatttctttgaatatttttagccccaccctctctctcctcccctgagactacaatatgaatgctagatcttttgttataattccacaggtccctgagtctctgttcatttgttttcaatctgttttctctctggtgtacagattatttaatttctattattttatttacatgtcctctgatgctttcctctgtaccctttattcagctttttaacacatccactgatttttttcattttggttattatatttttttaaatttccaccttttttaagtcttctctttctctgctgagacactattattttcatttgttttgagcattttataatttgttgaagcagttatatggtggctactttaaaatccttgccataaaattttagcatatatgtcatgttggttttggtttttattgactgccttttatcattaaaattgagatcttcctatattttggtataactgaactttttattaaaatctggacatttgagtattatgagactctagatcttttttaaaccttctgcttctacaagcctcctcttacaccacccccgcaaaggatgggggatggcactgccttattactgccaggtaggggtggaagtccagatttctcacttgacatccactaacacctggttatggagaggagaatcttcattactgttggtgggaatggaaaatctggctccctactagacttccattgataccaccctggctgggaaaggcaggcatgccccagaactgctcttcacatgaacttccctggcacggtggtgggtgacctttttactgctgggtgatggtgatagtcctgacttggccttccctaacaccaccccaacaagaatgggaaagtctcattaccgttgagtgggggtggatgtccaagctcctcatgtggtcttcactgatactgcagggaatatggtgaggaatagtctcacttggggatatctattctccccacttggcctttgttaacaggtgtggatttggagcttgtttttttctgtggtgtttggctaaagtagagcagctattgtctaaatgtttttctgtcttgctatgctgccacctttctgatcctgtggctgaagacagcaggcgttttccccctttgtctgtacccattggtatttctgggttgccagcatgtagatatataagacaaaattaaaacagctaactcactaccatgtttttccatgcatccaaagttccaaggtccctgactcgtctgccttcttcactccacctttcagagttttctcatgttttctaatatagaatgtccagagttttgagctttagttagaggaaggcatagagaaaagcatttctactctatctttcagaagaagaaatacctctctctttcatttagaagatgggattcttattgttttatacagatttcttgattgacattctttttctttcagcacactgaccatgttatcccactgccttctgacctcgatagtttctgatgaaaagtcaattgtagttattttttataagaacctgtatgtgatgagtcattttctcttgctacttttatgtttttctctttgtctttggctttttacagtttgacaatgacatattgaggtatggatcttctaaattttcttttcattggggttttttgagctttttggatatgtatgtgttaatttcctactgctgccatagtaaattacgacaaatagtgatttaaaatagctctggaggtcagaagtctaacgtgttcactgggctaaaatcaaggtgtcaaaagggccacattccttctagaggctttagaaaagaattattttcttgctttttcaagctttaaaagactgactatatttcttggcttgtggcctcttccaacattttcaagtctagcaattgcctctcaagtcttaatcatacagcacttccttgatactccttcctctgtcttataaaggcccttgtgattacactgggctcatgcagataatctaggataaccttctcatctcaagatctctaacaattatatctgcagtttcttctggtaacatattcacaagttttgatgattagaatatgaacatctttgaagggtcactgttctccctaaccacagtatcaaatgttttttaaaatcaaatttgggaagttttaaaatatttatttgaaggtggaaaaatcaactcaagaaaaggcagattagtaagagaaaaagcatataaccttattaacatgtgcacagagagaaccacaggatgtcttcccacctccaagggggtgcagaagtttatataacatctggaggttacagaaagaatggggactcagagtatggccaaaatcagggtttggtgataaatcaggttatagcagcatctggttatgggaggaaaagaagatacttggctagcaaagatgatcttattatataaatgaaacctcacaagcagcagccctcagagatactagatggtaaatgttactttcagacatttagagtgtgtcagaccatcagttaatattttctagctccagacaagggaagtcctggctgcatcaatgcagattctccacagatataaattttctccacaaaagacagatttgcaggactacttatgtttgctggctttttgacagccatctcaaaatatgctaaataaatatattttgggttaaaatatttttatgtctttcaactgggtggagggataaggagaagttggttgaacggtacaaaaatacacctattatagattgaaggaacatgttctaatattggatagtacaataaggaaattatagttaataatcacagactggggacctcggggggaggagccaagatggtcgaataggaacagctctggtctacagctcccagcgtgagcgacgcagaaaacaggtgatttctgcatttccaactgaggtactgggttcatctcactggggagtgccagacagtaggtgcaggacagtgggtggagcgcaccgtgcacgagccgaagcagggtgaggcatcacctcacccgggaagtgcaaggggtcagggaattccctttcctagtcaaagaaaggggtgacagacggcacctggaaaatcgggtcactcccaccctaatactgtgcttttccaacgggcttaaaaaacggcacacgaggagattatatcctgcacctgccttggagggtcctatgcccatggagtctcactcatttctagcacagcagtccgagatcaaactgcaaggtggcagagaggctgggggaggggcgcccgccactgccgagttagttgtttgattaggtaaacaaagcggccaggaagctcaaactgggtggagcccaccacagctcaaggaggcaggtctgcctctgtaggctccacctctgggggcagggcacagacaaacgaaaagacagcactaacctctgcagacttaaatgtccctctctcacagctttgaagagagtagtggttctcccagcacgcagcttgagatctgagagcgggcagactgcctcattaagtgggtccctgacccccgagtagcctaactgggaggcaccccccagcaggggcggactgacacctcacatgtccgggtactcctctgagacaaaacttccagaggaacgatcaggcaacagcatttgcagttcaccagtatactctgttctgcagccaccgctgctgatacccaggcaaacagggtctggagtggacctctagcaaactccaacagacctgcagctcagggtcctgtctgctagaaggaaaactaacaaacagaaagcacatccgtaccaaaaacccatctgtacatcaccatcatcaaagaccaaaggtagataaaaccacaaagatgggagaaaaacagagcagaaaaactggaaactctaaaaatcagagcacctctcctcctccaaaggaacacagctcctcaccagcaatggaacaaagctggatggagaatgactttgacgagttgagagaagaaggcttcagacgatcaaactactccgagctacaggaggaaattcaaaccaatggcaaagaagttaaaagctttaaaaaaaattagatgaatggataactagaataaccagtgcagagaagtccttaaaggacctcatggagctgaaaaccaaggcacgagagctaagtgacgaatgcagaagcctcagtagccgagcgatcaactggaagaaagggtatagtgatggaagacgaaaggaatgaaatgaagggagaagagaagtttagagaaaaaagaatgacaagaaacaaagcctccaagaaatatgggactatgtgaaaagaccaaatctacatctgattggtgtacctgaaagtgatggggagaatggaatcaagttggaaaacactctgcaggatattatccaggagaacttccccaatctagcaaggcaggccaacactcaaattcaggaaatacagagaacgccacaaagatactcctcgagaagagcaactccaagacacataactatcagattcaccaaagtggaaatgaaggaaaaaatgttaagggtagccagagagaaaggctgggttacccacgaagggaagcccatcagactaacagctgatctctcggcagaaactctacaagccagaagagagtggggagcaatattcaacattcctaaagaaaagaattttcaacccagaatttcatatccagccaaactaagcttcatcagtgaaggagaaataaaatatgttacagacaagcaaatgctgagagattttgtcaccaccaggcctgccctagaagagctcctgaaggaagcactaaacatggaaaggaaccactggtaccagccactgaaaaacatgccaaattgtaaagaccgtcaaggctaggaagaaattgcatcaactaattaacaaaataaccagctaacatcataatgacaggatcaaattcacacataacaatattaacattaaatgtaaatgggataaatgctccaattaaaagacacagactggcaaatcggatacagagtcaagacctatcagtgtgctgtattcaggaaacccaactcacgtgcagagacacacataggctcaaaataaagggatggaggaagatctaccaagcaaatggaaaacaaagaaaggcaggggttgcaatcctagtctctgatacaacagactttaaaccaacaaagatcaaaagagacaaagaaggccattacataatggtaaagggatcaattcaacaagaagagctaactatcctaaatatatatgcacccaatacaggagcacccagattcataaagcaagtccatagtgacctacaaagagacttagactcccaaacaataataatgggacactttaacaccccactgtcaacattagacagatcgagacagaaagttaacaaggatacgcaggaattgaactcagctctgcaccaagcggacctaacagacatctacagaactctccaccacaaatcaacagaatatacattcttttcagcaccacaccacacctactccaaaactgaccgcatagttggaagtaaagcactcctcagcaaatgtaaaagaatagaaattataacaaactgtctctcagaccacagtgcaatcaaactacaacttaggattaagaatctcactcaaaaccgctcaactacatggaaactgaacaacctgctcccgaatgactactgggtacataacgaaatgaaggcagaaataaagaggttctttgaaaccaacgagaacaaagacacaacataccagaatctctgggtcgcattgaaagcactgtgtagagggaaatttatagcactaaatgcccacaagagaaagcaggaaagatctaaaattgacaccctaacatcacaattaaaagaactagaaaagcaagagcaaacacattcaaaagctagcagaaggcaagaaataactaaaatcagagcagaactgaaggaaatagagacacaaaaaacccttcaataaattagtgaatccaggagctggttttttgaaaggatcaacaaaattgataaactgctagcaagactaataaagaaaaaaagagagaagaatcaaatagatgcaataaaaaatgataaaggggatatcaccaccgatcccacagaaatacaaactgccatcagagaatactacaaacacctctatgcaaataaactagaaaatctagaagaaatggataaattcctcgacacatacactctcccaagactaaaccaggaagaagttgaatctctgaacagaccaataacacgctctgaaattgtggcaataatcaatagtttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagccagcagagagacaaccaaaaaagagaattttagaccaatatccttgataaacattgatgcaaaaatcctcaataaaacactggcaaactgaatctagcagcacatcaaaaagcttatccagcatgatcaagtgggcttcatccctgggattcaaggctggttcaatatactcaaatcaataaatgtaatccagcatataaacagaaccaaagacaaaaaccacatgattatctcaatagatgcagaaaaggcctttgacaaaattctacaacccttcatactaaaaactctcagtaaattaggtattgatgggacatatttcaaaataataagagcgatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcacatgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagaaagccaaatcatgagtgaactcccattcacaattgcttcaaagagaataaaatacctaggaatccaacttacaagggatgtgaacgacctcctcaaggagaactacaaaccactgctcaaggaaataaaagaggatacaaacaaatggaagaacattccatgctcatgggtaggaagaatcaatatcgtgaaaatggccatactgcccaaggtaatttacagattcaatgccatcctcatcaagctaccaatgactttcttcacagaattgggaagaactgctttaaagttcatatggaaccaaaaaagagcccgcatcaccaagtcaatcctaagccaaaagaacaaagctggaggcatcacgctacctggcatcaaactataccacaaggctacaataaccaaaacagcatggtactggtaccaaaacagagatatagaccaatagaacagaacagagcactcagaaataatgccgcatatctacaactatctgatctttgacaaacctgacaaaaacaagcaatggggaaaggattccctatttaataaatggtgctgggaaaactggctagccatatgtacaaagctgaaactggatcccttccttacaccttatacaaaaattaattcaagatggattaaagactgacatgttagacctaaaaccataaaaaccctagaagaaaacctaggcaataccattcaggacatagtcatgggcaaggacttcatgtctaaaacaccaaaagcaatggcaacaaaagacaaaattgacaaatgggatctaattaaactaaagagcttctgcacagcaaaagaaactaccatcagtgtgaacaggcaacctacagaatgggagaaaattttcgcaacctactcatctgacaaagggctaatatccagaatctacaatgaactcaaacaaatttacaagataaaaacaaacaaccccatcagaaagtgggcaaaggatatgaacagactcttctcaaaagaagacatttatgcagccaaaaaacacatgaaaaaatgctcatcatcactggccatcagagaaatgcaaatcaaaactacaatgagataccatctcacaccagttggaatggtgatcattaaaaagtcaggaaacaacaggtgctggagaggatgtggagaaataggaacacttttacactgttggtgggactgtaaactagttcaaccattgtggaagtcagtggggcgattcctcagggatctagaactagaaataccatttgacccagccatgccattactgggtatatacccaaaggattataaatcatgctgctataaagacatatacacacgtatgtttattgcggcactattcacagtagcaaagacttggaaccaacccaaatgtccaacaacgatagattggattaagaaaatgtggcacatatacaccatggaatactatgcagccataaaaaatgatgagttcatgtcctttgtagggacatggatgaaactggaaaccatcattctcagcaaactatcacaaggacaaaaaaccaaacaccacattctcactcacaggtgggaattgaacaatgagaacacatggacacaggaaggggaacatcacacactggggcctgtcgtggggtggggggaggggggagggaatagcattaggagatacacctaatgctaaatgacaagttaatgggtgcggcacacccacatggcacaagtatacatatgtaacaaacctgcacgttgtgcacatgtaccctaaaacttaaagtataataataataaaattaaaaaaaataaaaaagaatctgggacctccccattctcactctcttgctcttgctctcaccatgtgacatgctggctctccttcaccttctgccatgactgtgaactttctgaggccctcatcaggagctgagcagatgttggtgccacgtttatacagcctgcagaaccataagccaattaaacctcttttctttataaattacccagtctcagatattcccttatagtaatgcaaaaaaggcctaatacagagttattcaagtctcttgaataactaggagtggaatggctgggatgtcttgtaggtacatggaattgtgtcattttttattcccacaagcattgtatgagtgtgtttatttccacatgttaagaaccaattcattgcaattttcttttttttagtaggacgtaagttgaattttttcaaaggctttttaagcatctgtggaggtaaccgtgtgattttttttcttactcctattagtattgtgcactctaatagtaggtttcctaacagaatgctaacaggttcttgcattcttcgtataaatatcaagtcatggtgtggtgttttttttgaatgttgcttgggaatctatttctaaattgtatttcagatttttgcatcaattgtcataaatgatattgctctatacttttcttttttgtgctaccattaccaggattaggtgctgatgttatatttatatcattaaaataatttaaaaattcaaaaaaaaataataactgactgtatatgtcaaaatagaatagaacaagtgtaatgtttccagtgcaaagaaatgattaatgttagaggtgatggatacaccagttaccctgatctgatcattacatatagtatactggtatcaaatatcacatgtactcaaaatatgtacaactattgtataccaataaaaatatttttatgtaggcatgtaatttttgcatccatttctatatattctctttttggtactttcattatgcaaatttgttatttttgtagtgttccacaggtctctgaggctctgttcattttttctcattctttattctttctattcctcagactgcataatatctattggcctagtttcaagtttcctgaacattcttctgaaactgcctttgcaaaaattttagcagtgagaaaaatctaatctgactccatcttgcttctaacctcacaagctaattgcctctgttaactttaaaataaagatgttaacagtcccttcctgaaactaactccttccttgctaagggacaaaaaccacttttgtatgactaacgaaaggccacagaattaggaccatgggagtagcttgaattctgctaaaatatacacatagttaatgataacaagccattgttccctagcttgcctttctatatagttgtttactgctctggagatcacaagatttgtaacttctccaattgttcctgtagataacatgactattgccaaaacctaaaattagtgtttgaaatatttttcagactgcgtattctggtgacaaactgattccacccagacccatgacttacaacaaggaactggctcaactagtcatgtgagcccccacccagaaactgattcagcatgtgaagatagtttgtacactcctatgatttcatctccaaccaatcagcagtacccattccctagaaccctgcctaccaaattatctttaaaaaccctagtctctgagcttttggggaggcagatttgagattatctcctgtcttctcatttggctggtcctgtgataattacatttttactgctgcaataccactgtctcagtgagttggcttttctgtttagcaggccagaagaactcattgggtggttacacttgtctctgctaaaactactggtttaactcatatagtgaatttttcattttcgttattgtacttttcaactccaaaaattctatttggtgatttttataacttttatctctttatagatacgctctatttggtgaaacataatttttacactttcctttagctattttaacatagtattttcttttttaacttatttttaatagctgctttaaagtctttgtctactaaatccaacagcttgtccccctcaagaacctttccaatcaaatgcagtgtttttcctatgtgtgggccatacttccttatttctttgcatgtctgattttttgtttttgttaaaactggacattttagaggagaagatattgtagcaactttagattcagatcctccttctatcttccaattttgttgttattgctttggggttttttaattgacaaagagtatatatatttatcatggacaacatgatgttttgaaatatgtgtatgacataaaatggctcaatcaagctaattttaaaaaataaaatcctgcttgatgcttgtttttttccatgacttttctaaaccaattctgtagattttgtatttcctggagtgtacagccactgagttttctgattactttttaaaaattctcatttttactttcaagcctgtctttttaggggtcacctctaggtcaacatagttgggtaattatccaatgattggtcagaagattttcttaatgctttgatccagtgtcttcaacgttttgccaaggagatttgtatgtgaaggcacatcttcaaatctaaaggggtttataagtcagcattaacatttacttcttgcttgcacagggctgcaagtttgcccaaatgtaagttactggatccctctctggttttccctggccatgcacttggtcctgtgcagcatgtgtagccttctggatctccaggaatatgtcagagctttacaaagtcctctgttatcatatgacttgttccccaagtcatccttttagatttttggccaggctcttttttgttatgggctgaattgtgttcccctcaaaatggtgaagtcctcacccccactgtcttagaacatggctgtttttggaaacagggttttaaaaaaggtaattaagttaaaatgaagtcattagagtgaattctaatccaatgtgactggtaatcttacaggaaaatgaaatttgtacacagatatgcacacagggaggacaatgtgaagacggacagaatggccatgtacaagtcaaggagaaatattataaaaatattgacagtgctctgaggatgggggttttcacaaagctcaaaacaggtcaaacttcttcactggctgccagctcttcacagctaccaccctggtactaggggttgggtacgtgggaatagttccaagttaaagcaccatagaccccactgttcttatgaagctcggcagttatatttgagtgaatgcttttcagtgtgttctgtgcctttggttaattttcatagttttaaaatggttggtttctattggtgttttgccagtatttttgttgcttttgtgggaagaggattcactgaggtcctcaccctgacattctgaaagtgttgtccctaaccttgtttttgaaatatatttatgttggttagacttttaggttgacaagtttgtttcctttcaagctgttgctccttaaaacattggaaggaaacaaataaacaatacagtcttttggcttgcattgcttggatgagaagtcagctgtcattctcatctctattcttctgcatgtaatgtgcgttttttcctagttgcttttaaaattttctatcactagttttgaccaatttgattatgatttgcatgctgtagttttctttctgtgccttgtttggggtttgttaagcttcttgaatttgggggcttaaaaatttcataaaattggaaattttggctactgtttttccacattttttgttcccttctctttcttgggctccaatgcatattaaggcacttgctgtccccaagctcactgatgttctgctcatttctcttcagtcccttttttcttttatttttttattttttgagacagaatctcactctgttgtccagcctggggtgcaatggcgtgatcacagctcactgcagccttgacctccagggctcaagctatcctcctacctcagccacccaagtagctggaactacaggcacaggcacgtggctggttaattttcatatttttttgtacagataagagtctttccatgttgcccaggatggtctcaaactcctaggtttgagcaatcttcccacctcagcctctcaaagagctgagattacaggcatgagccaatgtgcccaacctcttatttcattttggatattttctattagtatgacttcacattcactaacctttttctatatctaatttgctgttaatctcatcctgtgtatactgtatctcaaacattatatttttactttagaatttcaatattttaatatcttcaatgtctctccttgtcatatacataatttcctctactttcttgaacatataaatgtatttatagtagctattttaacatcattgctttataagtctataatctgtgtcattactgagtcttttaaattatattttctttttaatataggttgtattcccttcctgcttctttgtatgcctgaaaattttggattgacgccagacactgtgaattttacatagctaaatgaagaagttttagtattcctttaaggatttttggactttgttcttggacacagttaaattactcagaaataatttgatccttttaagactagcttttaagctttgttaggtgagcttagaatagccttttgcctagtgtcaattttgcctctctactaaggcatctaatgagtctactttgtatgtgttaggatttctttgcgcactgattggtgcaaagactaactattcccagccctgcgtgagctctccagattattccaactgatcctctctaatcttttccttggctctcatgtgctgattagcattctgctgaagagggaattctgtggatctctgagactctctttttatgtgcatctcctctccagggctctgccacgcaaattctaggtaccttgatctcccccaaactctgaattttctcttattaataaagggagaccactgggctccacttatgtaccccctccttgtgctgtggcctggacaccctctccatgcagtgagctggtgcattcatagggtttacctcatttgtttcccttgtctcagtactctctgtcccattccactcattgtttaatatctgaaaacacattttgttttatcttttcccccaagtttttagttattaagacagaaaagcaaatctggttacttttattccattatggaagaagttccaaaacctgattatttatttatttatttatttatttatttatttttttgagaaggtatctcattctgtcacccaggcaggaatgcagtgacatgatcttggctcactgccacctccgcttcctgggttcaaacaattctcttgcctcagccccccaagtagctgggattacagccacatgccaccatgcccagctaatctttatatttttagtagaaacggggtttcaccatgttggctagcctggccttgaactcctggccccaagtgatctgcctgccttggcctcccaaagtgctggaattacaggtgggagccactgcacccggcaaaaacctaattcttaaaatggacagttgaacgcttggattggcattcaaggggcttcaattacaggaaagtaaagaagggccaggaacattgtttgttgctctttaaatcaaatgaggatttaagattcaaccgtccatccagatgtaatgttcagaagtccaagcagtagggaatatagatagaactcaaatatgtctcatgtatgatagagactaaatatgtcctgagtaccccagctgagaaactataacaaattatcacaaatttagcagctttaaacaccacaaattttattatctcacagttctccaggtcagaaatccaagtacagcatggcttgacttattccttggcttggtttctcaaaagactacaattaaggtattagcaggattgcgtttccttctgaaggctctagaagagaatctttttctaggctcattcaggttgtcaggagaatttagttctatgtagcagaaggacatgagccccacttgcttttctggctgtcaatcataggtcattctcagcctccagaggctgccaggattccccagctcatggctcccttcaaagacagcaatggcacattgtgtccttcgtgttttggatctctctgactctgcttcttctgtttcatctcttttgctgtatgtcttctcactctagttgggaaaatgtgtcacttttaaatgctcaagtgattagatttggctgacccacataacccagaataatctccccatatcaaggtccaaagtcttgagtacatttgcaaagtccacttaacataaaacgttctcaggatccagggtttggggcatagacctctctgggcattggagggggtggtggtagaattatttagtccaccacatcagtgtacaggataaaatccccatcttatccttgacctttatatcccatgaagacaaatgaataaacaactatagtatccctgggagatctttgactttttacccttgctctgttacatggtttcattttggagactgggaaatatgtaaataccaaatatcatcacagaatatcagaggtggaaggaatgtcgtcaatcttctagtctagctctgttttacagatgaagaaattcatgtccagagacagaaagattctttgatgagctaatagagctgaacatttattctggatctccatatctttgccaatatgtggttttattaattacatgactatgggcatttacctaccctctctaaacttcagtttactcatataaaattaaggataataatggtacttcttaaaggtgttttaagcattaaaggaaataaatatacgtaaaggaagcatgtagtacagtaactgtacttggcatttagtaagtactgaaaataccagctattattatcattgttattattatattattattctaaaggtcaaagctgcatcaacacatagaccccttcttttgactgaattgattggttaataatttagtccaagcaattgtgaatttgaggttttatgttatgtcaccactttttccaacatgatgctttctgcttgactgatttgaacatttagataggtgagaaaatctatgctaccatgactgaacttttattttaaggtgataaagtaatacaatatttattttccattttaataaatctggtaattcattcattcataaaaccaatgtttattgagtgtcaattatcggtcaggcagtgaacaaagtagtcatgattcttgttcactcagcttattcaccagggagaaactggtagccaatgaataaacaaacacaaaaataaatattactttaaattctttgaaggaaaataataggatgctgcaagagatttaattaaaaaaacaactatgctagattagtggtcacaaggcttctctgagatataatattcaagctgagacacaaagaatgagaaggaataagccatgtagagaatgttcatgtgtttgacgatggagagggaaataaatacatacatttgaaatatacttgagacagagaatcaacaggatttgctgaaaaaatagatataggcaggggatgaaggaaggaaggactcaaagatgactcccaggtttctgaccaggagttagggaatattgtgagaaggaagtttagaggcagtaggtaattttatcaaccacttgttgttatttttatcaaacacttggtaattttatcaaacacttggtgttatttgcatcctcatgatattcagctattttaatttttagtttcagaggaaattttatctaaaagtattgacaaaatatacttccttacagaattcctgtaaaaatatgttcaaaaatgtaattataaaacaaaaaaaaaagcagatacaactgtaagggtagaccatagtacttattttatgagaaatatgtgaattcaattatataccagttgcttaaaagtggatctggtaaagttggtgaaaaagaattagagaaggcaagcccataaatagaaaataacgtcatattcttatcataaatagcatttgagtcaatatgaagaaatatgcaggggaaataacatttttgttgttgttgttcttaatttattttaaaattaaaaaaatatggaaagcttcacgaatttgcatgaaacttgaaatttaaagggaaacttgaaatgggagcagtggcataatggggagaatgtgtgttgtagattaactatgttcactgctctcttacatattacttatttaatccaaacaaaacctctgtaatccaaacattccatattgcacatggtcaaactaaggcatataaaagctaaataacttgctcaaggtcaaagctgacaagtgacaaaggcatgatttaaacccaagtctgtcaaactcccaaacccaattgcttacaccaggggttagtaaactttttctgtaaaagaacataaagtaaatagttcaggctttgcgggtcatatgttctctttatcagctactcaattcggccgttgtagtatgaaagcagttatagacgatacatgaatgaaagggtgtggctgtgttccagtaaaactttatttataaaaataggtggagtgctggattttactgctgaccactggtttacactcaggaaaaaagacagcttagcagtttctaaagaaaattgggaatccaagatacacaaagcttcgtttaaggacaatccaccaagaaaataatatcagatgcaaatgaatgagctctcaagattcctagaatttgggattgttatggcacagtctagcatatgtttgttgtttctggtaaagagggggaaagagatgaattaaaatttttaaataatccagaaatatcactctactcagttccaaatttgtctttcccccaaccttttactggagctacttactgggaaactgaatagtataagtttgatgttttcttttgtattctatttgttctctgagggatagaagaagccactggcagcacaaaggaaaagagagcaaagacgaagagacggatgctcaaagatttgagagggtataggatgaattcacttctgatgcttctagagtggtgttctgtcataattaccccaaatgatcagaagtttcttacacaaaatgggatgcttggtgtatttgttttctattgctaccataaccaattaccacaaacttagcagtttaaacaaccattaattatctcaccattctgtggttcagaaggtcaggtgtggcatggctcagctgggtcctctgctgaaaacaaggtgtcagctgggtaggatagagtgagactttgcagaagattctacttccaagtttattcaagttcctggcaaaattcagtttcttgtgattgtaggaccaaggttaccttttctttaacagtggccccctccatcttcaagccaacaatgacatgtcaagttctacttgtgatttgaaactctgactttatcttcagcccaagaaagatctctgcttttaagggcttatgtgattatcccttaaaagggccagtcaaggagtttgagaccagcctggccaacatagtgaaaccctgtctctactaaaaatacaaaaattagccaggcctggtggcacatgcctgtaatcccagctactcggtaggctgaagcaggagaattgcttgaacccgggaggtggtggttgcagtgagcctagatcatgccattgcactccagcttgggcaacagagcgagactccgtctcaaaaaaaaaaaaaaaagaaaaagaaaaaagaaagccagtcaaataagccaagataatctctgtattttaaagtcatgtgactagtaacttgagttacaactgcaatttctttctgtcatgtatttgaataacactagagggtaaagatcattgaggctaccacacacttggtaaggtagaatttggtattgtgacttttctcacggaagagagaagctgggagaaaaagtttggggctctggtataattcaccaactgttgtttttgcaacatcaatgctgactagatttccttccttacatctgaaaaaaaatttctggagagcatatggactaaggagagagaaaaattcctgtctaagagaatttttctggtggaggtgaagcgtgggcaaacaagttaatagacaatagtgatatgcatgacaagaagacggggcagagaatcaagagaatgagggcaatacaaaaccctattctcagagtcaagctacacaatccagaagagatgtcatctaatccaagaactaaaggatgagtaaaagttaatcagctctcctgatgtctgttatcatatcacattattattttatttatctcccaatattcatttcagttgagaaagaattcaaagtagtaaatcaaatggtggtcactgaattcatctttttaaatttttccaagcaccctgcattacaaatggttttcttcctgttctccttggtcatttacctgatatctcttctgggaaatgcagtcagggtcagtcctgccttctatactccagtgggttattttcttagccacttaagcttcctggatatctgctacatgtctaccaccatcctggtcatgctggtgaacttcttccaggagagtaagaccatctcttatgagggctgcctttcccagatcttcttccttgcattatgagccagcactgagggggttttgctggctgccatagcttatgaccactgtgtggctatttgccaccgtcttcaatataggctcctaatgagtggaaaggtctatgtttgtttggtgactgggttttggatgtgtgggctactcaattctgggacacacacagcactgacagccacactcactgcgtgaacccaaccccatcagctgctttctctgtgccatcccattgctcctgaagctctcctgctcagacacctgtcagtgagtctgtgctccatgtggtgagggccaccactggcctgagcccctgcctgtttatggcaatgtcctacatattcatcatctctaccatctttggaacagaccacttcaactatgacaggcccacagaagggtgctccctggacacagacatcctggtctctgtgctcttttgtgttgtgaccccagtgttgaaccccatcacctacagcctgagaaacaaggagatcaagggtgcagtgatgaggctgacaggaaaacatgaattctctagtgaggtcactgactagataatgtttcccattctggaaaatttcttaattagagaaaaacatgaacattccagtgactattataagaggttgcactccgtatagcatctcttgacaattttggtgccccatcccaccaggacaaacaattgtatctgcactgagaatttcacacattgcgatctcatgtacattgtgttctctccaatgaactgatattttagaacatttcatcatccacaaaagaagccccatacccattagcagccactaataattttccctagaaacctccaactttaggcgactatatttcttaagaagagtcaagtgaaacagtgggagtggagaaggaacaaagaaatctctacctggttgtgatcaagtagttataaacaccactgcaattggaacagccattaggcaactattaatgtactttatgtctcatggatttgcctgttctgaacatttaacataaatggaaatatacaatgtggtgtctttttaagactggcttctttcacttagcttagtgttttcaagtttcacccatgtagcagcatgttatcagtacttcattccttttaatgccaaataggatttcattttatgagtataccaaattttatttgtcagttcatcagttagtggacaaataaaaatacgtacaatatgttatcaaacttttttttatttttgagacagagtctcgctccgttgccaggctggagtgcagcggcatgatcttggctcactgcaacctctgcctcccaggttcaagtgattttccttcctcagcctcctgagtagctgggactacaggcgcgtgccaccatgcctggctaattttttatatttttagtagagacagggtttggccatgttggccaggatggccttgaactcctggcctcaggtgttccatctaccttggcctcccaaagtgctggaattacagctgtgagccactgtgcccagccatcatatgcttttaaggggtagatatatcctgacactgggtacagttcttctcaattgtgagaaataaactactggtaaataaagttaccatacatttattcatggtaaataaataaactacttaccacaaagtctcactgaaaggcttggatttctggctttggggggtggggcttgtgctccccaaactcctatggaaagaatactctttgaaacaactggctattgacctccatgcatcatgaggcagacctgcccttccaggagctgcctacggcgtagtcattgcctaacgcaaaatcactccacaattcattcttttagggccatctataaacacttggggactgtccttttgggagttggtgtttccactttttgtatattatgaataatgttgccaagaatacttgtgtacaagttcttagtggacttatattttcatttctttgggatacgtacctcggagttgaattgctgggtcatatggcaacttccaattttttcacattctcgtcaatatttggtatctgtctttttcataatagccatcctagtgagtaaagtggtatctcattgtttttgatttgtatttcctggatagctgctgattccaaggcctttaacaggcaccatctttgggcttcttcacatctggaaaaacccatgttgctaagggatttttgagctttaaacacataactcttaacattatgtaatgtttttatcttaattttggtgcaggaaaatactgcaagattttcagacttacacgttctccacatctgggccctacagagctgtttgatggctctgcctttttccccttcagtaactccacagcaagcagtgccatcagcaggtcatgagcaatggcaggaccagaaatcaggggccacgaaagtctaaggggtgcttgtgggaaaaaagggaagcactgcatgcagggggcagccctaactaggaaccgcttggagccgagacagcagacgtgctgtagtaccgtggctccagatacacgtccctctggtggggcatgtggcatgaagaggctaggtccaagcaaagcccatggccatggccaccagaacaaacagagaaaactccctcacgtgttgtaaaatccaaccaaataagcccacatccatgcatacgccttcactcactaactaggaggaggacaatgctgtccttcaggctttagcctccacaactcctgacaacaaatccagtgccaaactccattcacaaatgtccccaaagagatagaaagctgatctcctcattgcgtgctgggaaaagatgattgccacgaccttaatgaatccgagagaactaattgctcttcatttctacactttctaatcaagctgttgaccttgagttgtgtttgtatttggaggagtcccagaacatctgcttagagagagattagatggatactccccaaaggacagtccacaggcgtttatacatggccatcctagaagaaggaatcatggagtgatcaaaggggatttttggttcctgcattaagcaatgactacgccgtaggcagctcctggaatggcaggtccccctcacaatgcatagagttcaatagccagttgtaccaaagagtatgctttccatagtagtgtgggaagcacaagccccacccccaaagacagaaattaaagcctttcagtgagactcagtggtaatagtttattaccataaataaatgtatggtaactttatttaccaatcatttatttatttctcacaattgagaaaaactgtatccagtatcagagtatatctaccccttaaaagcataagatattgtgcataactttattaccatttattaccacttatgtaatgacataggcttaccatcatttcctgcattattcatttctgaagtagtaatgataaaaccagagttgaaatgaccttagagattatctacttgaaagcctgatagatgcctgaattcctcaagtggtatgagtggaaaatatatttacagttaataatatgcagtataatataaagtattactcctactctaattttgacaatcaggatagtagcaatagctttcagggaaaaagcacagggttacatttctcctttgatacattgtagtatgacagcaggggcacacaaaaatttgtttaaagaaaatgtaattaaattttcctaacacttttatttggatactttgttcactctactaggggttcttatctttacgttgtaacacctcagtgcttgccaggtgtgttacaagccactttggaataatcaagctctgaagtttgtgaatgatttatttctctcacaatcccttttaaaagaaaccttgggggaggagccaagatggccgaataggaacagctccggtctacagctcccagcgtgagcgacgcagaagacaggtgatttctgcatttccatatgaggtaccgggttcatctcactagggagtgccagacagtgggcgcaggtcagtgggtgcgtgcaccgtgcgcgagccgaagcagggtgaggcattgcctcacttgggaagcgcaaggggtcagggagttccctttcctagtcaaagaaaggggtgacggaggcacccggaaaatcgggtcactcccacccgaatactgcgcttttccgaccagcttaaaaaacggcccaccacgagattatatcccccacctggctcggagggtcctacgcccacagagtctcgctgattgttagcacagcagtctgagatcaaactgcaaggcagcagcgaggctgggggaggggcgccggccattgcccaggcttgcttaggtaaacaaagcagccaggcacctcgaactgggtggagcccaccacagctcaaggaggcctgcctgcctctgtaggctccacctctgggggcaaggcacagacaaacaaaaagacagcagtaacctctgcagacttaaatgtccctgtctgacagccttgaagagagcagtggttctcccagcacgcagctggagatctgagaacgggcagactgcctcctcaaataggtccctgacccctgactcccgagcagcctaactgggaggcaccccccaacaggggcacactgacacctcacatggcagggtattccaacagacctgcagctgagggtcctgtctgttagaaggaaaactaacaaacagaaaggacatccacaccgaaaacccatctgtacatcaccatcatcaaagaccaaaagtagatacaaccacaaagatggggaaaaaacagaacagaaaaactggaaactctaaaaagcagagtgcctctcctcctccaaagggacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagtgagaagggaagtttagagaaaaaagaataaaaagaaatcagcaaagcctccaagaaatatgggactatgtgaaaagaccaaatctatgtctgattggtgtacctgaaagtgacggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagctgatctctcggcaggaaccctacaagccagaagagagtgggggccaatattcaacattcttaaagaaaggaattttcaacccagaatttcatatccagccaaactaagcttcataagcgaaggagaaataaaatacgttacagacaagcaaatgctgagagattttgtcaccaccaggcctgccctaaaagagctcctgaaggaagcgctaaacatggaaaggaacaaccggtaccagccgctgcaaaaacatgccaaaatgtaaagaccatcaagactaggaagaaactgcatcaactaatgagcaaaataaccagctaacaacataatgacaggatcaaattcacacataacaatattaactttaaatgtaaatggactaaatgctccaattaaaagacacagactggcaaattggataaagagtcaagacctatcagtgtgctgtattcaggaaacccatctcacgtgcagagacacacataggctcaaaataaaaggatggaggaagatctaccaagcaaatcgaaaacaaaaaaaggcaggggttgcaatcctagtctctgataaaacagactttaaaccaacaaagatcaaaagagacaaagaaggccattacataatggtaaagggatcaatttaacaagaagagctaactatcctaaatatatatgcacccaatacagaagcacccagattcataaagcaagtccttagtgacctacaaagagacttagactcccacacaataataatgggagactttaacaccccactgtcaacattagacagatcgacaagacagaaagttaacaaggatacccaggaattgaactcagctctgcaccaagcggacctaatagacatctacagaactctccaccccaaatcaacagaatatacacttttttcagcaccacaccacacctattccaaaattgaccacatacttggaagtaaagctctcctcagcaaatgtaaaagaacagagattataacaaactatctcccagaccacagtgcaatcaaactagaactcaggattaagaatctcactcaaaaccgctcaactacatggaaactgaacaacctgctcctgaatgactactgggtacataatgaaatgaaggcagaaataaagatgttctttgaaaccaacgagaacaaagacaccacataccagaatctctgggacgcattcaaagcagtgtgtagagggaaatttatagcactaaatgcccataagagaaagcaggaaagatccaaaaatgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctgcttttttgaaaggatcaacaaaattgatagactgctagcaagactaataaagaaaaaaagagagaagaatcaaatagatgcaataaaaaatgataaaggggatatcaccaccgatcccacagaaatacaaactgccatcagagaatactacgaacacctctatgcaaataaactagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagccgggcagagagacaaccaaaaaagagaattttagaccaatatccttgataaacattcatgcaaaaatcctcaataaaatactggcaaaaggaatccagcagcacatcaaaaagcttatccaccatgatcaagtgggattcatccctgggatgcaaggctggttcaatatactcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacatatttcaaaataataagagctatgtatgacaaacccacagccaatatcatactgaatgggcaaaaactggaagtattccctttgaaaactggcacaagacagggatgccctctctcaccactgctattcaacatagtgttggaagttctggccagggcaattaggcaggagaaggaaataaagggtattcaattaggaaaagaggaagtcaaattgtccctgtttgcacatgacatgattgtatatctagaaaaccccattgtctcagcccaaaatctccttaagctgataagcaacttcagcaaagtctcaggatacaaaatcaatgtacaaaaatcacaagccttcttatacaccaacaacagacaaacagaaagccaaatcatgagtgaactcccattcacaattgcttcaaagagaataaaatacctaggaatccaacttacaagggatgtgaaggacctcttcaaagagaactacaaaccactgctcaaggaaataaaagaggatacaaacaaatggaagaatattccatgctcatgggtaggaagaatcaatatcatgaaaatggccatactgcccaaggtaatttacagattcaatgccatcctcatcaagctaccaatgactttcttcacagaattggaaaaaactactttaaagttcatatggaaccaaaaaagagcccacatcaccaagtcaatcctaagccaaaagaacaaagctggaggcatcacgctacctggcatcaaactatcctacaaggctacaataaccaaaacagcatggtactggtaccgaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtacaaagctgaaactggatcccttccttacaccttatacaaaaatcaattcaagatggattaaagactgacatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccattagagtgaacaggcaacctacaaaatgggagaaaattttcgcaacctactcatctgacaaagggctaatatccagaatctacaatgaactcaaacaaatttacaagaaaaaaacaaacaacgccatcaaaaagtgggcgaaggacatgaacagacacttctcaaaagatgacatttatgcagccaaaaaacacatgaaaaaatgctcatcatcactggccatcagagaaatgcaaatcaaaaccacaatgagataccatctcacaccagttagaatggcaatcattaaaaagtcaggaaagaacaggtactggagaggatgtggagaaataggaacacctttacactgttggtaggactgtaaactagttcaaccattgtggaagtcagtgcggtgattcctcagggatctagaactagaaataccatttgacccatccatcccattactgggtatatacccaaaggactataaatcatgctgctataaagacacatgcagacgtatgtttattgcggcattattcacaatagcaaagacttggaaccaacccaaatgtccaacaatgatagactggattaagaaaatgtggcacatatacaccatggaatactatgcagccataaaaaatgacgagttcatgtcctttgtagggacatggatgaaattggaaatcatgattctcagtaaactatcgcaagaacaaaaaaccaaacaccacatattctcactcataggtgggaattgaacaatgagatcacatggacacaggaaggggaatatcacactctggggactgttgtggggtgggggaaggggagagggatagcattgggagatatacctaatgctagatgacgagttagtgggtacagcgcaccagcatggcacatgtatacatatgtgactaacctgcacaatgtgcatatgtaccctaaaacttaaagtgtaataaaaacaataataaaataaaataaaaaataaaagaaaccttgaggttattcctaaataattttattcccaatcatttgccttagagattattgattgattgggaaagaggcaggattgctgctctctggctgggaactgagcagaacgtgccacatggtctccattgcaaccattgctcttacagggccatggtgccacatttatgccccagcaggctcatcttttcctcaggtctctaagatgttttcaccagaactgctgaacagaaatgcccttcagaggtcagctgagatgttccttcttaattttctttctctgcaggtctgactaaagtgctggattattttatctttcctgttcccctgacttccacttgacttgtttgtgaacagcgtttgtgcctcaagctttgggtctctattcagcttcagtagacagggagtctggatgccattaggagtatcaagctctgtgatgccagggtcaaggatgtgaggcacctctcataggtagggcgttggaggccagtccttctccactctgacatacatgttcatgagaaggggctcagaatttgacagtggttctatgctgtcaaggtcacaggctggagaagaagtgcaattttctgtgagacccctatagagttaccctcctctccaagctgagactaagtacgcaggttaagaaacgccaatctatgtcatgttcgaggcagagacagatgttgagaaatccgtgcctgataaacactacatactatgatgctggggctcccttggggtaggggcaattggtggaaaaataaaatagctaatcatttaaatcatttttataattataaatccaagaacttggtttaactgatcttatgagtaatttcttttcatagtgtgtggcttttttggtgcgaatttgcttgaacttttaggaaattaaaaagttgtagatatttccctgatttgctcctctctttatttcttattccacaaaacattttttttgcaggacagtgaactggaaaaattatgttcttcaatgtcagatggacaggattaaattctagcatcttgtaattgcagttgtacagccttaagcatcaaattcctcacttgctaaccctaataaaatctatattatgatagataagagataatgtgttcaaagcagccagcatcaataaacagcagctaccgttatacttgggctattgttatcatcaatcccagggcttttgaagagggctatgaaaggatgcaaagaatgttggaagtgttggtgaagctggctttttttatttgctttgtcataaatgcatgtaaacgaagtactgaatggacatacaccaaactgtgaatagtggtgctgggcagattttggtatgatggtgaagatacttcattttcatttgatatgtctttgactcagataaatttttcagtgagtatgtgctatttaaaaatgtttaaaccccataacaattttcattttaaaaatatgagggaacttccctatatatttctttataacttcctgtgaatctataagtatttcaaaattttctaaaatgtaaatgataaataaaatgttgaatctatgtatttatctatctgtgacagaccaaggcggcgtgtgtgtgtgtgtgtgtgtgtgtgtgtgtgtgtgtgtgtgtgtgacagagtctcactttgtcaccctggcatgatcttggctcactgcagcttcagcctccccggttcaagaaattctcatgcctcagcctgtcgagtagctgtgatgacaggcgcccaccaccatgcttggctaatttttgcatttttggtagagacagggtttcaccatattggcgaggctggtctcgagcttctggcctcaagtgatctgcctgcctcgacctcccaaagccaaggaggctttcagtcatgtgaaatatttaccattccagaagatgttcatagatactaaaaagggattttctcaagttggatgaatacaaaggagtgcatttatatgttaggtttgatccagtcatatgaaacatgaaattttcatgatcttaataatgccaagtttttgcctgtgtaatgacatggatagaacaatggattgaatctcagggctgaaaaaaaaaaacagtaagaattaactcaaatgatcttcacttgagacttgagtcagtctttttggtaggtgatctagctaacatttgagcaactgcagtaatggactcccattactctctcaatattgtaaaatgcttgcttatctagcttacattcagttagtgaaccagaagtttcaaggctaaaaaagacaaaagaagaatagatatcaggccaattaggcccaagggaaatttcagttcaagttgatttttgacaatttggccaagtgaatttccaagaagtacttggaatgaaacaagtatgtagagttgtgagcaggtaacctgatattcatacagcaggaagtgggaggtggtattgctcagtggtcaaaatcaaggctctgaatttaggctaccagtgcatcctcttgaagcctcggttttcttatctgcaaaacaggactaataacagtactaaccctatcaagtttctctgagaatgaatggggcaatccatgaagagttcctggcacatacatcatgttcatcaagtattaaataggaggcacagtgatggcgttagcaatatgtgcaggtggataggagaacacagtgccctacttttaggcggccttgactgtgtaatcacaaattttgtaggaagttttccaaagctgaatgggtgagaacaaggtaaactttaacgtcattagtatagactgtttgagatgaaagggacctcaatccatctcacttcacgaaaatactcttgatttgcacacacatcaaggtttgagaaatacacgtctatttgataacctctgaatatttcatgtggtccttcatgcccatattatgtggaagtgtacaaatagtaacctggggcaaagaagagcttatattccatagccacagattaactttgccacaaacacctcaaatcttctggacttgctattagaaaaattctcctgaatgctattattaattgttgagagagagagagaaagagagacagtgtttgtttgtgtgtgtgtgtgtgtgtgtgtgtgtgtgtgtgtgtgtgtccatgttttaagtatataggcaatttactaggctacatgaaaattagatttaaattttttaattattgccttgtattactgaaatcaaataagaatagatatgctgtttttcttatgtgttcccaggattttcataattacatcaactaccctggtttattttatgcccatcctgtttcctttaagagagtaaattactaaggttagtcaacaaaacattccctaaaggttagcttttattatataatgtgtatttctatttattatttagtttgaaaaatcccaattgaattgaggtatgtaaaaatgttgtttcttttcaaagtaactcattgagttttgttttgttttgttttttgattggataggttatcataaagctatcttcatctttaaagaaaaacacttcctttaaactaaattcagcaagatttctttcaagctagacaattttgtgtatagaatcagtcaaagaaaacttattctccatctatttttcctatgaaatctatcctcactcatcagtgggaaaaaagatcattactataaggcagagggtttgagattgaggttgcctattcatatacagtatgtataaatcccaagaggcaagaatctagagtatcacataagctattatgtataagtggcacttgttaataatggattttgatgatgatgatgatggtgataattcaccattgttgtcctatgcaaacagtatgagcatgaaaaatatggaaaataaaatagacatcactcctcactcatcctcctggcccacaaaaagactagccaatcagaagaaaaaagtttagtacagttctgattctacataatatatatattatattctacgagtatgtttctcaggaatgggcttcaagtcatatttaaaacatgtaaaataagcagtgtgtgcagcttcagaaaccatatttttaaaaatccctaaacatttaaaaatcacttttacaatttggttatacacagatcagtccttgttttctttttgtgtggctacctttcatgaagaattttatttctttctatgaataaatctagacatctccctataaaagagattgttgtgtcaaccttttccatatcatgagttaaatgcatgtcaccgtgtaattgatggagaaaacaaacaatagtacacacattacatacaaattttctgagaggacatgcagattcccagcccgaacagaatgttgctttactgttaagcaatgcctacagctaacctagagaagtgctgagtatcagtaaacctacttcttggatgcatcttacaccatacttcctataaacttcaaggatcacaagtcccaccttagccctctcttctcactccattattctccttggtggattccatgtacatctatggcttcaacagcctttaaggcaatgacacctttaaggcaatgactctcaaatctatacctagaataggtatatcctgtctcctgaggacaagtcctggatttttgactgcctgttgagactctccacatggatatcccataggtacctaacactcaacattacttaaatctccactatcttctatcccaaaactgttgcacctcatttatttcctgttttaattaatgatcccaccatccactcaggctgcccaaactgatttggtgtcgtcaccacccatagactttaatgtgcttcaaacttggccccttttccacaaactattgctttagtggttttctccaagctccaaagccatctttacgtctgtacatcttcaattacagaccattttacttgatctggttttagctctcaaactactctcttgaactaaacaaagacgttttaacctgaggaacatggactataagggacttattatatgacccctttgaaatcacagatactcctcgacttataatggggttacatcccaataaacccctcaaaagcagtaaataccgtaagtcaaacatgcatttaacatacctaacctactgaacatcatagcttagcctagcctaccttaaacatgctcggaacacttacattagcttacagttgagtaaaatcatctaacacaaagcttattctataataaagtgctgaatatctcatgtaatttattgaacactgtactgaaagtgaaaaacagaatggctgtatgtatgggtacacaaaatatggtttttactgaatgcatacagcttttgcgccatcacaaagtcgaaaaattctgaatcaagccattatacgtcaggcaccatctgcacattgaagattctgtgcatgggtacacatgcatttctggatctgtagattcttatcagtttctcagagctactgattttctaaaacccaggcatctacctccatatactccctgcttctaatctgcccttacctaaaatgtaatttacgggccatcactgatactctgcagtcatcctggtccattctcacaccaaagcctggcttcctgctgcctcatgaggggagggattattttctgaagcccctgttgaaggactactcagctgttttttttctaaggactttgctcagagggcagacctgacatagccctcacatctcagtgttattccccaaaggcagctgattctctgctacctcttctggggtagctaatgagcttgtgcttgaaatgaaaataatcaggctctttaggattagtcatggggtttggtggaaccacccagggctgacctactagctctctgcaactagcagaaatctccagggactggggacacagctgtaggtgacggggttgccagcaaagctcagaactctgcagttttccttcctctaatagaaacaaagctctcagcaaagttcactaggatcttgaggcctactggatgctttctcctacaaacatgagaacaacatgagtcttttgagttttcttgcccttggctggacagatgcctattttatttgaaatttctgccaccaatattgcctgggatgctgacctgccatctttttgcttatggaaaagagttttcacacatgcttacctccacaataaaacacacatccacacacacacacacacacacattgtgagcatggcttttcatctgtgttccagggttcataggaccaccaaccaggctgactctcccaaattaatcattatgaggagaatgaattgtatttgcatatgcatgaaggggcaaggctgtaggcagggaaacaatttaaaggcagttgcaataactgagataaaaggtgataaagtattgaactataattctggtagagaggaagtagaaagatgagaaaaagggaaaaatatttaggaggtcccgtaatttactggacttaggtctgaccaatcctaaaataatcattgtgtgaaaaacacctcttgcttttatcttcctccttattttatttttaaaaagtgaattctatttaacatatagtaaaatgcaaaaatcttcagtgtacaagctgatgaatttttacctatatatgcaacaatgtaaccactacccaaatgaagatatagaacatttctgtcagtttagaaaatttcttcaggctccttttcaaacaatgtcattcagaagggtaattactataaaccaaaaacaaaatcctaagtccccaaccaactgaacagacaccctctgggccaaggggatcccatagaacatgaaaaactgaattcccagccattatgggaagggaggttggacacatctcattatactccctcctttttggagtttaggcacaactgaccagcattatcattaagatggagatcataagactgacaaaatagactctttattgctataagataccaaattccaacatgactctgggacagcatcatgtgacagataacagtccctgaaggaaatcaaaatattttactgcaaaatatatttctttgaaatattttgaaatgaccctgcaaagccatcttttgtggggaaaaaaatgcattcttagagaatctccattaccgcagccaggcctttcatggatctaggaaagattaattaagagtctgacaccttttaaggtctgaaaagagacatttgccatctattctctctgaatgctgctgcctggaggcttcatctatataacaagaaccttggtctccacaaagcccctcccccttaactcaagcatttctttctactgtcttcaagtcttcagtcaaaacttacctctttcaaccaattaccaattagaaactctttgaatccacctattacctataagccccaacttcaagatatcctgcctctttaggctgaaccagtacatctttcatgtattgatttatgattttacctacaatccctggcccatggtcactcatatgggctcaaaataaacctccttacgtattttagagagtttggttttcgtgttaacactactatgcttgctttatcaccagagattaattttgcctatttttgaacttcctttaaatagaaactacagtacaaattcttttatgtctaacttctttcatttaaaagaatatattttaggtttgctatccaaaacaccaccaggatgactaaacagtagaaaggagagctttattggtagtaattgtttgcaagctgggaagagaaagtctccatcgtggactgaaggtctctctctccaaagagggtagggacaggttgggttttatgccttacagggcctctgtcatagatattcagcaggtttggaagaaaagttatacatatttatgatgggacttgagtgcatgcataatggataaatatacatgcaacatacaccccatgttcactttgggggcagggctttagcattaaaatgagatgaaatttgactctacatcgaaaggtaaactgtagggcacaaaggcagtctgtgtgcagcctctataagctgggtgaaattggctttgggcctgcaattgcttatcagagaagaacgtttgttaaggccagttttctatccaatcggagttgtagtggtctgggctgtaaatcagagctgattgctctgatttgttagagagtttagctgtaagaatttagaaatttgtgaggccagccaggcccagagcttgactagtaaggaaactaactttgttttcctaacccttgggtcatcctaattgataaaggggcatctattttggtgtcttagatcacagatttatcaatgttttcagatgtatcaatattttaattaaccatatagtatttccatatgtatataccatacttttgtatccattctcctattgataagcataccactgatttctagtttgtgctttatgaagaaatttgttttgaacagttttatacaagtcattttgtatgcatatacacttacttttcttgggtatatacctagaagtggaatttctgaatcacagagtaactatgtttgactctttgaaactgccaaataattttcaaaagaggctgaattgatttccagttttgactcgtaggtttagatagctggaagaatgttgctcccagcattatagcaacaaagctggacataatgtgaattcatgacttttcttgaacccatcagggaagtgagattgcaaggcaaatgactaaatagaaaactggggagattagaagcatgtagggagaaacggcctaaacattttgtaacccgaggtagtagccatcagatgccatagaactggtaagaagactcatagcttttttgtgaatttaattaattgctaaggagtgagcaaagtccctgggggccacagacataaggtttgcacccttttgcttttccaccatgaactcctccagatgctcacagtgaagaccaagcagtattctgagaaagcttccctaatgctgcagtgtgggaagggtgggggaggagcagtcactgccaaaacttctccgtgacccatttcccatatttttcctgcagaacaaaagccacaatccgcagagcaaaaccagaaagctgtcacctcagtacactgtggaaactcattctagctgggaaagggacagggaccaaaaagtctgacccatcagggaggggcagaaatgagtgctaggcccacactacagctggaagaagggcaggatcactgtgaaaatcatgccccaaggcccagtcacaatacctaagactgacgcttacccagaacacaacagaacaccttccccctcctccctggtagccaggctaacaagcgatgagtaaaattaatagtggaatacatctcgaaatgtttaagaaaagtgttatctctggggttagccatgtgaagggaagacccaaagacaagcagggagtagaaattaaaacaaacaaaaacctctggcaaactttcctatggcctaagcacaaggtatcactggagaaatttgaagtctgcagcgcactgagggtaaacacctcaacacaaactccaaattcagcccaccccctgactagattagcacatgctccaacattagaggtctagcagaagaagagacatactcatctctaagcgaaaaaaaaaatgtttttacctaattctctactgtcctatataacatttgtaatttcagcaaaaagttatgaagcatacaaaaaggtaagaaaataacagtctgaagagacaaagcaaacatcagaccagactaagatgttaaagagagatgaaaactatgagacagggaattttaaattactatgattaacaggttaaggaatgtggaggaaaagtaagcaacatgcaagatcagacaggtaatttcagcagagagatggaaacaatgagaaagatcaaatgaaaatgctaaaataataaaaaaaaaaacagaaataaagatgaacaccttttatgggttcatcagctaaaaaaagaatcagtaaacttgaaaatatgttaaagaaatcatcagaccaaaacacaaagacaaataatagtaaaaaaaaaaacaaaaagaaaatcccagagtatcagacagctattgtacaatatctaacacatacacaagttgagtcccagaagtaggattataagaaaatacatctcaaaagatccagaaaaatcacttaacaaaatttaatacctattcacgataaaaactcttagtaaagaagagatagatagtaacttctttaacttttaaggaacatctaggtctttgaggaatcgccacactgtcttccacaatggatgaattaatttacaatcccaccaatagtgtttgtttttctctacaaccttgccagcatctgttattttttgactttttaataacagccattctgactggtgtgagatggtgtctcactgtggttttggtttgcatttctctaatgattagggatgtcgagcctttttttcatggttgttggccgcatataaaacagaaataccatttaacccagcaatcccattactgggtatatacccaaaggaatagaaatcattatattataaagacacatgcatgcatatgttcattgcagcactattcacaatagcaaagacataaaatcaacctaaatgcccatcaataatagactgcataaagaaaatgtgatccatattcaccatggaatactatgaaactataaaaagaatgagatcatgttctttgcaggaacatggatggagctggaggccattatccttagcaaactaacacaggaacagaaaaccaaataccacatgttctcacttctaagtgagagctaaatgatgaggacacatggacacatagatgggaacaacagacactggggcctactggagagtggagggtgggaagagaaagaagatcaggaaaaaagaggatccgtactaaaggatactaggcttaatacctgggtgacaaaatactctctacaacaagcccccatgacacaagtttacctatgtaacaaacctgcacatgtatccctgaacttaaaataaaagttaaacttaaaaaataaaataaaataacatctgaacagaactctacagctagtaaaatagtaaaatactgaatgctttcccctgagatcaggaatgaggtaaggatatcctaagtgctcctatttcacattgtttaaatttgcatttacctgatgttgatgcatcttttcctaagttattggcatttaaatatattattttgtgaagtccctgttcatgtctgttgcaggagtctgggcaagacaaaatggtgacttggactggggtatcactagtgatggtggtgagaaatgacagtatttgtaaaatttggaaggtagagtcgaacaaaatattttatcctgaaatattttacatggactacaaaataatagcattgacagcttcagttgattgaatacctctgaagtaccaggtacattatttattttatatcacattacttcttccaacaactctgatataggcatgaataatatcagaatacaatgaacaaactgaagaaccaggaagtcagctaacttatccaccatctacacctagtaagcagtagaagtaggatttaaaaatccccatctatctgattcaagagcccactctttccaacatatcacctcctctctaagattgaaaaagatgagaaaattacagttcataaaaatggttgtgagcttattagaatggatagcttaatagaaagtgggtaattctatcaatttttttcaagaaatatgtaatgttgggctgaggataaatcttggattaatacaatttaataaggtaacatatctaagtacatatgtttaaaattgttataccttttaaactctgaaaagataaatgacccaagtgatttttaaaaattagtatatttcaaaacagagtcttaaatttttattctgaagagataatcagagatgctcacatttatgtgcgaaattacagcattcatagggaatggagacaacctgaatgtttaaccaaaaaggagatatgaagtttatttcatataatgaaatacaatgcatccctaagaaatgaagctcataactttttgtcatttatttttaattgtggtaaaatacatatgtttattagttgaccatttataagtgtacaattttatggcatgaaatacattcacaatattgtataaccatcactgttatctataaccaaaactctttcatcgtcctcaacataaactctgtacctattaaacggtaactccccatttcaactcaccttcaagcccctggtaacctctattctattttccgtctccattaatttgcgtgttccaggtatttcatgtaagtggagtacaaatacaatatttatctttctatatctggcttattttacttagcataatatcttcaaggtctatccacgttgtagtatatatcaaaatttcattcctttttatggctaaataacaattcgttgtatgtatacacattttatatctgctgatggacactggggttatttctggcaattgtgaacaaggatgctatgaactgggatatacaaacatctgtttgagtacctgctttcaattctttcagatgtattcctaggagtagaattgctggatcatatggtagttctatgtttaactttttgaggaactgtcaaaatgttttctaaagcagctgcaccatcttatattaacatcagcaattcacgagggttaaaatttctccacattgttgccaacatttgttattttccattttctttattatagccattttagtaaataaaaactagtatctcattgtagtgttgacttgcattttcctaatgactaatggtgttgagcatcttttcaggcccttatttgtatatcttctctggagaaatgtctatgtccagtgtccacgtttgaattggttggtttttattactgttgttgagttgtaggagttctttatattatgaatattaatgcattactagatttctgatttgcagatattttcttccattctacagattgtcttttcactttattgatggcatcctttggatgacactttcttaatttcaacgaagtaaatgttacctactttttcttttgttgtctgtacttttggtgttatttctatgaaataataatccaaattcaaatccaatgacatgaagattgtccccaatttttttctgagactttgacagttttagctcttatatttaggtctttgatcaattttgagttaattttgtatatagtgtaagttaagggccccacttcattctcttgcatgtggatatatagttttcttaggaccattttctggaaaaactgttctttccccattgaatagacttgacatgcatgtttaaaatcaattaaccaagggatgtgaaggacctcttcaaggagaactacaaaccactgctcaacgaaataaaagaggacacaaacaaacggaagaacattccatgctcctggataggaagaatcaatatcgtgaaaatggccatactgccctaggtaatttataaattcaatgccatccccatcaagctaccaatgactttcttcacagaattggaaaaaactattttaaagtttatatggaaccaaaaaagagcccacattgccaagtcaatcctaagccaaaagaacaaagctggaggcatcatgctacctgacttcaaactatactacaaggctacagtaaccaaaacagcatggtactggtaccaaaacagagatacagaccaatggaacagaacagagcactcagaaataataccacacatttaaaaccatctgatctttgacaaacctgacaaaaacaagaaatggagaaaggattccctactcaataaatggtgctgggaaaactggctagccatatgtagaaagctgaaactggatcccttccttacaccttatacaaaactcaattcacaatggattaaaaacttaaatgttagacctaaaaccataaaaatcctagaagaaaacctaggcaataccattcaggacataggcatgggcaaggacttcatgtctaaaacaccaaaagcaatggcaacaaaagccaaaattgacaaatgagatctaattaaactaaagagcttctgcacagcaaaagaaactaccatcagtgtgaacaggcaacctaaaaaatgggagaaaatttttgcaagctactcatctgacaaagggctaatatccagaatctacaatgaactcaaacaaatttacaagaaaaaaacaaccccatcaacaagtggacgaaggatatgaacagacacttctcaagacatttatgcagccaacagacacatgaaaaaatgctcatcatcactggccatcagagaaatgcaaatcaaaaccacaatgagataccatctcacaccagttagaatggcgatcattaaaaagtcaggaaagaacaggtgctggagaggatgtggagaaataggaacacttttacactgttggtgggactgtaaactagttcaaccattgtggaagtcagtgcggtgattcctcaaggatctagaactagaaataccactggacccagacatcccattactgggtatatacccaaaggattataaatcatgctgctctaaagacacatgtacatttattgcagcactattcacaatagcaaagacttggaaccaacccaaatgttcatcaatgatagactggattaagaaaatgtggcatatatacaccatggaatactatgcagccataaaaaatgatgagttcatgtcctttgtagggacatggatgaagctggaaactatcattctcagcaaactatcacaaggacaaaaaaccaaacaccacgttctcactcataggtgggaatggaacaatgagaacacttggacacaggaaggggaacatcacactctggggcctgttgtgaggtaggggaaggagggagggatagcattaggagatatacctaatgtaaatgatgagttgatgggtgcagcgcaccaacatggcaaatgtatacatatgtaacaaacctgcatgttgtgcacatgtaccctacaacttaaagtataataaataaataaataaataagaaaatcaattaaccatatatgtggaggttgatttctgagctctctggtctatcccatcagtctatgactgttcttattacagtaccatactgtttcagtttagtgtatcgttattgtaagttgcaaagccaggaagtatgagtcctctaactttattcttccttttcaaggttattttggctatccggggccccttgcaattccatacaaatttgaggaggggcttttacatttctatgaaaatggctgctggaatatgatatggatttcattgaatctgtagatcactttgggtagtagtgataacaaagttaagtctttctatcaatgaacttaagacatatttccgtttatttaggtttttctttaatttatttcaacaatgtttcgtagttttcagagtacaagttcttcacctccttcgtaagatttattctaactacctaattcttttgtgtactgtaagtagaattggtgtcttaatttcttttttgaattgctattgctagtatacaaacacacaactgattgttgtgtgagcaactttgctgaatttgcttattagggctagtagttttccagaagattatttgatattttctctatatatgatcatgccatacttgtatagaggtagttttagttcttcttttccaatctggaaaaattgttaatattttaaagctatagagatcaagatttacgtaaaacaaaaaaaactacaatgaaatacactgaaaggtagtattgactgattctgcagatgactgaattatttatagctttctgcatgttcttaaatttttgtaataaaatttgttttattacttgccaggcacagtggctcatgcctgtaatcccagcactttgggaggccaaggcaggcagatcacaaggtcaggagatcgagaccatcctggccaaaatggtgaagcctcatctctactaaaaatacaaaaattagccaggcatggtggcacgcgcctgtagtcccagctactcgggaggctgatgcaggagaattgcttgaacctgggaggcggaggttgcagtgagccgagattgtgccactgcactccagcctggcgacagagcaaggctctgtatggtttcttttttctttgttttgtagctgtgacaccacttgaaataagcaatcaaacatatgtcaccaaattcatcttttgggtattttccaaccactccaacctacaaggcttgttcttcctggtctttctggtcatttacctgacactctgggagaatatgctcataatggtggccaccagatttagccctccacattccactgtattatctcctcagtaacctgagcttcctggatatctgctacatgtctaccaccatcctggtcatgctggtgaacttcttccaggagaagaagatcatctcctacgaagcctgcctttcccagatctttttccttgcgtcatgagccagcactgagggtgtcttgctggctgccatggcttatgaccactgtgtggccatttgccaccctcttcaatataagctcctaatgagtgaaaagttctgtttggtgactgggttttggatgtgtgggctggtcaattctgggacacacacagcactgacagccacattcattctgtgtaaacccaacccaatcagccactttctctgtgtcatcccattttaattatccagtcccaaaaaatagcagtcactccctatttgcccccaattttgtagctctaaacaaccactaatctgtttctgtgtttttggatattgctattctggatgtttcatataaaggaaatcatataatatgtgccgggtatgtctagcgtctctcacttgatataatgttttcaagtttcatcaacatgacagcatgtatcagtacttcattccttcctactgctaaataatttccatcatatagatataccagattttattaacccatttatcactcgatagacattttggttattttaactttttatgaataatgctcctataaaaatttatgtacgaatttttggtagacaaatatttttatatatcctgggtgtacagctaggaaaagaagtgttggatcatatggtaaatctatgtttaactttttaaagaacttccagacagttttcaaagcagtggcactgttttacattactaaaaacagtggatggggtttctaatttctctaaatcctcaccaatacttattgttatgtctgccttttattataaccatcctggtatgtatgaagcactacatcaaatacgattttgatttacatttccctgaaggataatgaccctaagggttttaagaacctccatttctgtgctacttcttcacacatgggaaaacccgttgctatgggatttttgagctttagtgacttaactcttaacactgtctaatgtttttatcttaattcggtgcaggaaaatactgcaaaattttcagacttataccttctccatatctaggccctacagagctatttgatggctctgcctttttccccttcagaactccacagcaagcagtgccatcaccaggttatgagcaatggcaggaccagaaatcaggggccacaaaggtctaaggggtgctggtgggaaataagggatgcactgcatgcagggggcagccctaactaggagctgcttgaagctgagacagcagacgtgctgtagtaccatggctccagatacacatccctctggtggggcatgtggcatgaagaggctaggtccaagcaaagcccatggccgtggccaccagaacaaacagaaaacactccctcatgtgttgtaaaatccaaccaaataagcccacatccatgcataccccttcactcactaacgaggaggaggacaaggctgtctttcaggctttagccaccacaactcctgacaacaaatccagtaccaaattccattcagagtgtctccaaagagctaaaaagctgacctcttcattgcatgctgggaaaagatgactgccatgaccttaatgattccaagagagaactaattgctcttcatttctacactttctaatcaagctgctgcccttgagttgtgtttgtacttggaggagtcccagaacatctacttagagagagattagatggatagtccccaaaggacagtccacaggcacttatacatggccatcctagaagaaggaatcatagagtgatcaaagaggatttttggttcctgtgttaggcaatgactacgctgcaggcagctcctggagtggcaggtccccctcatgatgcatggagttcaatagccagttgtaccaaagagtattctttccatagtagtgtggggagtacaagccccacccccaaagccagaaatccaagcctttcagtgagactcagtggtacgtaggttatttatcatcacaattgagaaaaactgcccaatgtcaggatatacctaccgcttaataacatactgtatattgtgcatatttttattaccattttggtaacatttatgtaatgacgtatttttaacatcttttctgtgtgtataaatttcaacagtacaacttatagaattagagtagaacttactttagaaattatccactccagaacctaaggaatgcctgagttatttaagtgagataatataagtgaaaaaatttttatgatataatacaaaatgcaaagtattagtattctgtttttgacaagcaggacagaaaggaataattttttgggagaaagcatagggatatatttccactattacacattacagtacaacaataggtgcagacaaaataattgtttaaagaaatttgattaaattcatacaaaacatatatttggaaacatttattcgctaaccaggggttctcatctttatgtggcaacacattgatgtttgggagaggtgtgttgcaagcaatttattgactataataaaggcttgaagcttgcgaatgatttactttacctgtgattctttttattataaatatacatttaaagttatttgtaaataatttcatccccaatcatttgccttagagattactgattgggaaagaaagaagcaggattgctgctctctggctgggaactgagcagaacgtgccacatggtctccattgggaccattgctcttacagggccatggcgccacatttatgccccaacaggctgttcttttcctcaggtgtctaagatgtttgcaccagaacggttgaacagaaatgtcctccagaggtcagctgagatgtcccttcttaacctttctctgtaggtctgactaaactgctggattttatatctttcctgttcccctgacttccacctgagttgttcgtgaacagtctttgagccccaagctttgggtccccgttcagcttggatgccactgggagtatcaggctctgtgataccagggtcaaggacctaaggcacctcataggtagggcattgcaggccagtctttctccactctgacatatgtgttcatgagagggggctcagaatttgccagtggctctatgctacctctggcataggcttgggaggagtgcaattttctgtgagatctccatagagttaccctcttgtcaaagttaacacaggttaaaaaatgcaaatctatgtcatgtttcaggcagacacagatattgagaaatatgtgcccaataaatactatatggtctcatcatgagactgatagggtaaatataattggtagaaaaataagtcaataatttcatccttttttaattccaagaaattcatttgatcagtgttagcattaactttagttttgacttgttttgtttcgttgttgctgctgattgaaccaattctcaggagattgaaaagaggtaggtatttttcttatttggacctttctctctctctttattttatggaactatggaatgcagaacagggaattggaaagagtatggcctttagagtcagatggacatgggttaaatcccagtccctaatatagtagccaggtaacttgaagcatcagtttccctaccatcagagtgaacaggcaacctacagaaggggagaaaatttttgcaatctacccatctcacaaagggctaatatccagaatctacaaggaactcaaacaaatttacaagaaaaaaatcaaacaaccccatcaaaaactgggtgaagaatatgaacagacacttctcaaaagaagacatttacgcagccaacagacacatgaaaaaatgctcatcatcactggccgtcagagaaatgcaaatcaaaaccacagtgagataccatctcacaccagttagaatggccatcattaaaaagtcaggaaacaacaggtgctggagaggatgtggagaaataggaacacttttacactgttggtgggactgtaaactagttcaaccattgtgaaagacagtgtggtgattcctcaaggatctagaactaaaaataacatttgacccagccatccattactgagtatatacccaaaggattataaatcttgctgctataaagacacaggcacacgtatgtttactgtggcactattcacaatagcaaagacttggaaccaacccaaatgtccatcaatgatagactgattaagaaaatgtggcacatatacaccatggaatactatgcagccataaaaaaggatgagttcatgtcctttgtagggacatggatgaagctggaaaccatcattctgagcaaactatcgcaaggacagaaaaccaaacaccgcatgttctcactcacaggtgggaactgaacaatgagaacacttggacacagggtggggaacaccacacactggggcctgtcatggggtgacagggatagcattaggagatatacctaacataaatgacgagttaatgggtgcagcacaccaacatggcacatgtatacatatgtaacaaacctgcatgttgtgcacatgtaccctagaacttaaagtatattttaaaaaaaagcatcagtttccttacttgcaaatcttaatcaacacctactatataaggttgttgtgatacatacatgggactgtgtgtacaaagcacccagtacagttcctggtacctcgtaagtacttaataagcagtagccaccattatatttggggctatcattactgtcaatcacagggttatgtagggatggaaaggaagctgggattgtttgttaagccggtttctgttatttggtcaatcatacacaaataacacactgtgaacagtgatgctgagcagagtgttctgtgaaagggaagacattccatttacattttatgtatttttcacttatgtgaaatttttcagtgagcatgtgctactttagaaatttaaaattcctatatagtttttatttaaaaaatgaaatgtaagtacaagactccccgtatagttccttaacttttcctgtgattctataattgttccaaaataaaaaattttaaaatctctatttgataaataacataaaataagggatacacatatatattacataatattggagccaaggaggcttctggtcatgcgaaatgtttaccttcctggaagatgttcataaacaccaaaagtggatttccacaaggtaggtgaatgctaagagacgactgatgcacttggtctgatctgatctaatgaaatatgaaattttcgtggtcataaaaatgctatgttttcacattgacagaacaatgggagctaaaaaggactataagaatcaactcaaaagatcttcacttgagacatgagttaatcttctttgcaggagatgcagcaatccagcctctatttgaatatctccagtaaaggtatctcattactctctatatattataaaatgcttgcttaagtagcctaaattcaattaatgagacaagaagttgcaatgttaccaaaaaaaagaaagaatagttatcaggtctctatacttatatttacacacttcaattaagtagaaaggtggagatttcaattcaatatgccaagtggattactgagaaattcttggaatgaagcaagtaagtagagttgtaagcatgtaactgaatattcacacactgttataaaaagggggtgttgctcattagtcaaaaatgtgactgaattcagaataccaggagaaactcttaaagtctcagttttcttatctgcaaaatggggttaataacagtatttacactttttagttgttttgagaataaatgggataatccatgaacactggctggcacatagcacatgctcaacaagtatttaataagatgaacagtgttggtattagtaatatgtacaagaggataggaaaacacagtgccttactttgaagtggccttgactggctaatcacatattttccaggaagctgtccagtgctgaataggtgagaacaacaaggtcatctttttatcatcgccataggctgctgagatagaagggacctcagaggtcaaccagtctggatctttgtttaggaaacaatgaaacagaagcctaaatcatactctaacagaagtaaatctctaggttactcccttcataatttttaaagaatatgtgatttgagacaaacaggagggggccaaaagttggagcaactcagaaggaaagagccaatcctgggcaccagcctccatggctttgcttctctgctctctttacctcaaatgattatccccatatttctgcctgtttaagtcctttaaggtccatcacagtgctacgtctttaaaaagcttttgatatctctaatcccatagacgttctttaccgtgcttctatattcatcaaacatttattgaacgcatgcttgtacatgaggctccaggctacattttcatatagaattgaaaggctcagactgtaacttcaaggtatgtgtatttaagatggaactgggggctttgagcaagcactgagtgttctattcctacaagtgttcagccaggggctatctgaccaaagattagtaaagaaaaaaaaataataataattttaaaagtaaacaaaatgtcacaaagctctctgcctcatattgtagtttaccttcccattagattgtttgtttactgaagacaggaattaggtcttactcccctttgggtctctttataatacctgttacagagctgtactagaccctatggaggaactaaattggtttgaattgaaaactagccactaccaaagaaagattattggaaaatgctgaaagtaagaatttcttagcttgaagaattttatagctagaaggcacttacatgtcataagaggtagcaatttgtctttcctttttcctttacactaggagaagtgcaggtgagatataaagcaatgaaagaaatattaaatgctagaataaatttctgagatgcaatggagaatttttcttgacaaataattattaagacaagacttaacctactaattttagaggtaaacgtagctctgtcaggtggaaagagcttacacttgtcgctcaagtgtggtccctgggtcagcagcattggtgttgcctgggaacttactggaactgcaggttatttacatgcacgttcaagtttgggaacacactggcctgcacaatgacctctgaatatgccatctggttctaggcactcatattatgggagagcttacaaatagaaatctaggccaggtgaaaataatccatatattcatggcaataaattaacttcaccacaagcacctgaaataatttggttttcttttagagaaattgtcctacatactggtattctgagtgtgtgtgtgagagcatgcatgcacgtgtgcgtgtgtgtggtttaagtagatcagcaatttactgggcaacatgaacatttgatttaaaaattttaatcattgctttgtgttattgaaattaaatataagtagatgtttccctgatgtgctgtaaggactttcaaaagcacatcagttactctagtttatgcccattttgtttcttttgaggaaataaaccccttaaggttagtcaacaaaacatttcatttattgccaaagcaaaaaaaaaaaaaaaattcctcttttaagacccccatgcttattttccagagtttatacttacattttaaaattatttacgcttaacttcagtaccaactttctattgaaatttaaatactttaagctcctgaagcccctgagatttggaatttttaatgaaagctgtactggcatattaatcacatgccttgaattctcagaatcaaagataaaaatgcattggctttccagactatagagcagtttgcaaatataagatattatcaggtatcactattaataattattatatgacttaaaccctctgtgcttcagtttatttatctccaaaatgggtgtggtaggttgtcttataggttattatgtgaatcaaataagttaatacatgtaaaaagcttagatgtaatacatgtaaaaagttagcacataatataaatttaactagtgctggctatcattatctaatgtttgtttctatccattacccagtttgaaaaatactgtttgaattcaagtatgtaaaaatgttgcatcttttcaaagcaactcattgggttttgattggatgcattatactaaaatcaatttaatcattaaagaaaaacatactttgaaactattaagcaagatttttttttttctgagatggagccttaccctgttgcccaggctggagtgcagtggtgtgatctcggctcattgcaacctccgcccgccaggttcaagcaattcttctgcctcagtctcctgagtagctaggattacaggcgtgtgccaccacgcccagctaatttttgtatttttagtagagacaggatttcaccatgttgtccaggctggtctccaactcctgacctcgtgatctgccctcctcggcctcccaaagtgctgggattacaggcgtgagccaccacgcccggcctaagcaagattcttttaaagccaattttttggtacagaatcagtctaagaaaaatcaccctcaaattatttttttctatgaaatctatctatctccatgtgatcatggagaataaagtcattattgtacaggagagggtttacaatgaggctacctattcctaggaatacgaatttaaattctaagggacaagtgtatattatattacagaaagtttcatgcataggtggtgattgctaataataaattttaatgacgatggtggtgattgtctcagtcctttttgcattgctgtaaaggaacacctgatgctgggtagttcataaataaaagagttttatttggcttacagttctgcaggctgtacaagaagcatggcaccagcatcttctggtgagggtctcaggaagcttccaatcatgacagaaagggaagtggagctggcatgtaaagtggcgagagagaaagaacgagagagaggaggagatgccaggctttttgacaatcagtcatgacgtgaactaatagaatgagaactcactcattactgcaaggatggcaccaagctgttcatgacagatttgcccccatgagccaaacctcccactaggccccgcttataacatctgggatcaaatttcaacatgaaatctggagggtgaaatatccaaactatatcagggatgatgagtaataagaaaaaataaggctgggcacagtggctcaccctgtaatcccaacactttgggaggctgaggttggcagaccacttgaacccaggagtttgtgatcggcctgggaaacatgtccaaatcccgtctctgcaaaaaatacaaaaaattagccaggtgtggtggtgcatgcctgtggtcccagccactcaggaggctgaagtgggaggactgacagcctgggaggttgaagctgcagagagccaagattgcaccactgtactctagcccaggcaacagagccaacagagcaaaaccctgtctgggaaaaaaaaaaaaaaaagaaagaaagaataagaaaaaatagattcacattactacttctcccatcttatccccctggcccacaagaaattagattagccagtcaaactaaggaaaaaaagttataggtagacatatatagagagattttttttaatgccccatgaatatgttcctcaggaactgacttcaactaatatgaagtcacatttcaaggcgtttataataagtagtgtgtgcaacctcagaaaccatattttagaaaatccctgaaaatttatattcacttttctaatttagatatccatagactgggtggtgtttggatcagtttcccaaagtaaactcttacagaaccaccttccatgaggaatttcatttcttcctgtgaatacatctagacagctacctataaaagagattttcatatctacctttttgatatgaggagttaaaaaaaaccatgtcactgattttcaaatgactcgaagtttatgcagttaacagagaaaacagaataaaacacgcacataagaaatttccaggagtacatgcagattcccagctcagttccagtgctgatttattgtaaatcattgctaataagagactaataagggaaatgcttattatttagggaaattacttaggaaaagcaatgcctacagctgacctagatagggtggtattttcaaatccttcctggatacctcttcaccacatttcctgtaaacattgagaagcacaagattcccaccttagccttcctctcctctcactgtatctattctccttgatggaatttatgtacacctgttgctgcaacagttgtcttcaggatgactcccaaattaatatctgcagttctagcctgtctcctgagaccaaatcctgtattttgaaccacctattaggaatttctgcatggagatcccacagttacctaacattcaacattatttgaatctaatccactatctcctcccgctaaacctgctctatctcatgtatttcctgccttaattaatgattccaccatccagcctgcctgcccaaattgactccatatcctcacatgtcctcaccacacatagactttaaagtgcttcaaacatggcttcctctctgtgaaccaatactgcagtgattttctccaagctccaaaacatctttggctataaaccatttcattttaatctgtttttagcactcaaactacactttgggaccaaacagaagtgttttaacctgaggcacatggactatcaacaacaggcagactctgcaactcttcttgctcattcttacaccaaagcctggcttccaggcagacacatagcaagacccacatctctgaaaaatacttttttaattggcccagcatggtggtgtatgcctatagtcccagttacttatgaggctatggcatgaggattgcttgagcccaggagtttcaggctgcagtaagccatgatcacaccactgcactccagcctgggcaacagagtgagaccccatcttaaaaataaaggtaggaaaaaatacagcctgaagagacaatacaaacatcaaaaccaaactcaaatatgagaaatatttttaaactatcagacaaggaatttaaaattataatgattaatagcttaaaagccctaatggaaaaagtaaccaatctgcaagatcacatagttgatttcagcagagaggtgaaagctataagaaaagatcaaatggaagtgcaataaatgaaaaacatggtaacaaaaatcaagaattcatttaacaggctcttcaataaacttgatacagctgaagaaagaattggtgaacttgaaaataggtcaacagaggccgggcgcagtggctcacacctgtaatcccaacactttaggaggccaaggtgagtggatcgcttgaggtcaggagttcgaggccagccaggccaacatggtgaaacccccatctcaggccaggcatggtggctcatgcctgtaatcccagcactttgggaggccaaggcaggtggatcacaaggtcaggagatcaagaccatcctggcaaacacggtgaaaccacgtctctagtaaaaatacaaaaacaaaattagccgggcgtggtggggggtgcctgtagtcccagctactcaagaggctgaggcaggagaatggcgtgaacccaggagggggagcctgcagtgagcctagattgtgccactgcactccagcttgggtgacagagcgagactccatctcaaaaaaaaaaaaaaaaagaaaaagaaaaaaaaggaaaccacgttctatgaaaaattacaaaaaaaaaaaaaatagctagatgcagtggtggacacctataatctcagctactcaggaggctgaggcagaagaatctcttgaaactgggaggcagaggctgtggtgagccaagatcatgccactgccctccagcctcagtgacagagtgagacttcatctcaaaaattaaacaaaaggaagaaggaaataggtcaatagaaattacacaaatcaaacacaaggagaaaaaaagagttaaaaacaatttttaagccagagtatccaagagatatggtacagtaccaaactgtctaacatatacaaagttggaatttgagaaggaagagacaagtagtaggagaaaaaaaaaaaaccaatacagcatcacaaataagaattacagcagacttcacatcacaaactacacagttgctaaatgaagtggtgtgacctctttaaagtgctaaatgggaaaaaagaaaaaaataacctgttaacctgaagacatcattcaaatattgagagaaataaggattctctcagacaaataaaaactgaaggaatgcgttgccaacaatatactctaaacaaatgttaatgaaagtttttcaggtataagaaatatactgtaagtcagaaacttggatctatacaaagaaatggagaatgttagaaatgaattaaattaagataaatatattgggttgaatagtgttcccctagcattaatgtctaaccagaatgtgatattatttggaaatagggccttcgaaggtgtaattatttaagatgagattatactggattaaggtggggcctaaacacaattagtggcatcattataagaaaaggagaggacaaataaaggcacacacaaatgagagtgccatgcaaaaatagaggcaaagattggagtgatgcagctacaagccaaggaacaacagggattgtcaagaaccactagctgttaggaagagacacaaaggtattcttccctagagccttcaaactgggttttaaaaggcaatatccaactatatactgtctaaaagaaacccactgtaaatacaaagagaggggagagttgaaagtaaaagaagagagaaagatatacgatgcatatgttgcatagtaaaagtggacaaaggatatattaattttagacaaaatagacttcagaatgaaggaagatcaccagggattaaaaggaatattgcacaaggataaatcacatctccaagaagacattgtacctgaaaaagaacttcaaattacatgaggccaaacctgacagatctgaaaggaaaaatagacaaatgcacaattacagttggagactgcaacacacctttctcatcaacaataaatatcaagcagagcatattctttggccataatagaatattagaaagatatctagaatattcctaaatattggctattaaacaatacattttaaaataacttatgaagcaaaaaagtctcaaaggaaatttttaagtattttgaactgaatgaaaataaaaacaataaatcaaaaattctgaaatacagctaaagcagggtttagacagaaatatacaccacttaatgtgtatattacaaaagcttgtatctataatcattaacctatacttctgccttagagaaagagtatattaaacccaaatcaaataaaagtaaagaaacaataaagatgtgagaaaaaaatcaatgaaattgaaacagtagagaaaaatctgtgaaaataaactagttctttaaaaagagcaataagattgataaacatctaggcaggctgactaagaaaaaaagacagaagacacaaattataaatatcaggaataaaacaagagcaatcaatactgaccctacattattcaacatagtgttggaagttctggccagggcaatcaggcaggagaaggaaataaagggtattcaattaggaaaaaaggaagtcaaattgtccctgtttgcagatgacatgattgtatatctagaaaaccccattgtctcagcccaaaatcttcttaagctgataagcaaattcagcaaagtctcagtatacaaaatcaatgtacaaaaatcataagcattcttatacaccaataacacacaaacagccaaatcatgagtgaactcccattcacaattgcttcaaagagaataaaatacctaggaatccaacttacaagggacatgaaggacctcttcaaggagaactacaaaccattgctcaatgaaataaaagatgatacaaagaaatggaagaacattccatgctcatgggtaggaagaatcaatattgtgaaaatggccatactgcccaaggtaatttatagattcaatgccatccccatcaagctaccaatgactttcttcacagaattggaaaaaactactttaaagttcatatggaaccaaaaaagagcctgcatcaccaagtcaatcctaagccaaaagaacaaagctggaggcatcatgctacctgacttcaaactatactacaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaagattccctatttaataaatggtgctgagaaaactggctagccatatgtacaaagctgaaacttgatcccttccttacaccttatacaaaaattaattcaagatggattaaagacttaaacgttagacctaaaactataaaaaccctagaagaaaacctaggcattaccattcaggacataggcatgggcaaggacttcatgtctaaaacaccaaaagcaatggcaacaaaagacaaaattgacaaatgggatctatttaaactaaagagcttctgtacagcaaaagaaactaccatcagagtgaacaggcaacctacaaaatgggagaaaatttccacaacctactcatctgacaaagggctaatatccagaatctacaatgaactcaaatttacaagaaaaaaacaaacaaccccatcaaaaagtgggtgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaacccttgtggaagtcagtgtggcgattcctcagggatctagaactggtaataccatttgacccatccatcccattactgggtatatacccaaaggactataaatcatgctgctataaagacacatgcagacgtatgtttattgcggcattattcacaatagcaaagtcttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagaacacatggacacaggaaggggaacatcacactctggggactgttgtggggtggggggaggggggagggatagcattgggagatatacctaatgctagatgacacattagtgggtgcagcgcaccagcatggcacatgtatacatatgtaactaacctgcacaatgtgcacatgtaccctaaaacttaaagcataataataaaaaaaagaaaatattttcccactcattcttcttgtctttttttctttaacttcttagattcagtgaaaaactcctatagtgctatgtgcattcaaaacaattgtttatcccatagttattcagtgtcacactctataaaaatcaattaacagaggtaggttgcattgctgaaatcttcaactaaaattatgggtttgtctatttctccttttagtctattaatttttgcttcatgtagtttgaaactaggttattaggtgcatacacatttcttaaatacagtcccatatttatattttaaagagttcaagttttaaaggatgtgttagtatcatatttttagtagaatctatattacttgatgtgatttttaaagttttattgagacataactcacacaataaaattcacccttttaaattgtataattcaatgctttttaataaatttatagagctgtgcaaatatcaccaaacccaacattaccaacattttcatcagttcaaaaagatttctaatttccacttgcaatcagtccccatttctatttccagctccaagcaaccactaatccacgttctgtgtctgtaaatttcatattctggacaattcatgtaaattgaatcatataatgtgtccttttgtgtctggcttatttcacttagcataatgttttcaaggttcatccacactgtagtatgtatcagtacttaattcctttttattgcccagtaatattccattgtatgtgtacacctcattttatttatccattcagcagctgttggacatttggactgcttgcactttgaagtatgaatgatgctgctattaacatgcatgtaccagtttttgtttgaacatgttttcatttctcttaggaacatacctgggggtggaatttctgggtcatttccttttgaagaactgccaggccattttccaaagcagctataccattttgcacccccaacaacaatgcatgaggattccaattccttcccatccttaccaatgttaattagctctcttttatatcatagctatcctactatgtatgaagggatatttcattgtggttttgttttgcatttctctgatgactaaggatgttgggcatgttttcatgtgcttattcgccatttatgtatcttctttttaacttttattttaggtttgggggttcatgtgaaggttcattagataggtaaactcatgtcatgggggtttgctgtttagattattttattgcccaggaattaagcctagtacacaatcattatcttttctgctcctctctctcctcccacccttcaccctcaagtagaccccagagtctgttgtttccttctttgtgttcataagttctcatcatttagctcccaattattaaaagtaagaacttgcagtatttgtttttcctgtttccgcattagtttgctgaggataatggcctccagctccatccatgttcccccaaaagacatgatctcattcttttgtatggctacatagtattccatggtgtatatgtaccacattttctttatacagtctgtcattgatgggcatttaggttgagtccacgtctttgctattgtgactaatgccacagtaaacattcatgtgcatgtgtctttatagtaatggtagaatgatttctattcctctgagtatatactcagtaatgggactgcagggtcaaatagtagttctgcttttagctctttgagaaaaccactgctttccacaatggttgagctaatttacagtcctaccaacagtgtataagtatttccttttctctgtaatctcgccagcatctattattttttgactttttaataatagtcattctgactagtgtgagatagtgtctcattgtggttttgaatttctctaatgatgagtgatactgagctttttttcatatgcttgttggccacaaactatgtcttcttttgaaaagtatctgctcatgtcctttgcccacttttcaatggggttgtttgtttttctctcgtagagatgtttaagtttctcatacatgctggatatcagacctttgtcagatgcatactttgcaaaattttctcccattgtgtaagatgtctgtttactctgttgatagtttctttttctatgcagaagctcttaaatttaattagatcctatttgtcaatttttgcttttgttgagattgctcttggtatctttgtcatgaaatatttgcccattcctatgtccaggatattattgcctaggttgtcttccagggtttttatggtttggggttttacatttaagtctttaatccatcttgagttgatttttgtatacagtgtaagaaagggatccagcttgtcttctgcaaatggctagccagttatcccagcaccaattattgactagagataagttttttctgcattatttgtttttgttagctttgtcaaagatcaggtggtcataggtgtgcaaccttatttctgggctctctattctgttccattggtctatgtgtctattttcgtgctattatcatgctgttttgattactgtagccctgtagtatagtttgaattcaggtaatgtgatgcctccagttttgttctttttgcttaggatttccttggctatttgggctcttttttggttccatataaatttttaaattgttttttctagttttgtgaagaatgtttttggtagtttgataggaataacattgaatctgtaaattgctttgggcagtatggccattttactgatattttttcttaatatccatgagcataaaatgtttttccatttgtttgtgtcttctctgatttctttgaaccgtgttttgtaaatctcattatagagatctttcacctccctggttagctgtattcctattttattctttttgttgcaattgtgaatgagattgcctttctgatttggctgtcagcatggctgtttttgatgtacaggaatgctagtaatttatgtacattgattttgtattctgaaactttgctgaagttgtttatcagctgaaggagcttctgggcagagactgggttttttagatatataatcatgttgtctgcagatagcaatagcttgacttcctctcttccaacttggatgccctttatttctttctcttgcctgattgttctggctaggatttcctatgttgaatagaaatggtgagagaggaacatccttgtcttgtactggttttcaagggaaatgcttccagcttttgcccattcagtatgatgctggctgtgggtttgccatagatggtttttattattttgagttaagttccttcaatacctagtttcttgagagctttaaacataaaagggtgttgaattttattgaaagccttttatgtgtctattgatataatcacagtttttgtctttatttctgtttatgtgatgaatcacatttattgatttgtgtatgctgaacaaaccttgcatcccagagatgaagcctacttgattgtgatggatttatttttgatgtgctgctggattcagtttgcaagtgttttgttgaggattttggcatcaatgttcattgaggataatggcctgaggtttcattttttgttgtgtctctgccaggttttggtatcaggatgattctggcctcatagaatggattgaggaggagtcccccgtcctcaatttttctgtaagaatgctaccagctcttctttgtacatctggtagaatttggctgtgaatccatctggttctgggctttttttggttggcaggctatttattactgattcaatttcagtgagtgttattggtctatttagaaaatgaattctttccaggttcactcttgggagggtgcatatgtccaggaattgacgcatcttttctatattttctagtttgtgtgcatagaggtgttcatagtagtttctaatggttatttctatttctgagggatcagtagtaacattcacttcattatttctaattgtgtttgtttgaatcttctattagttttttcactgttttctattagtttcattttattagtttttttcatttcatttgtttttcatagttttttattgttttttgaaaaaaaaaaacaactcctggattcactgatcttctgaatggcttttcatgtctcaatttccttcagttcagttttgactttggttttttcttgtcttctgctagctttggggttgatttggttttgattctctaaatctttctgttttaatgttaagttgttaatttgagatatttctaagttttgatgtaggcatttagtgcaatgaatttctctcttaatactgccctagctgtgtcccagagattctggtatattgtgtcttcattctcattagtttcaaataacttcttgatttctgccttaattgtgttatttacccaaaagtcattcgggagcatgctgcttaatttccatgtaattgcatggttttgagtaattttcttagtcttgacttctatttttattgcacagtggtccaagagtgtgtttggtatgatttcagttcttttgcatttgctgaggattgttctatgtccaagtaagtggtcaattttagagtatgtgccatgtggcaatgagaagaatgtatattctcttgttttggggtggagagttgtatagaggtcagatccatctggtccaatgttgagttcaggtcttgaatgtgtttgttaattttctgcctattacagtcaatacactcaatgatctgtctaatactgtcagtggagtgttgaagtctcccactgatactgtgttgaagtctatgtctcttcgtaggtctctaagaacttcctttatgaatccaggtgctcctgtgttgggtgcatatgtatttagaatagttagatcttctcgttgaattgaaccctttaccattatgtaatgtccttgtctttttttcatctttgttgatttgaagtctgttttgcctgaaattaggattacaacctttaatcaaattacaaccttagtaatcaaattacaaccttactaagcaaatgatttcctccatccttcaattttgagcctatgggtgtcatttcgtgtgaaatgtgtctcttgaagacagcataccattgggttttgcttttttatccaggttgccactctgtgccttttaagtgggggcggttagctcatttacattgaaggttattactgacagatgtgaatctgatcctgtcattgtgttgctagctggttattgtgttgacttgtttgtgtggttgctttacagtgacattggtctatgtgtttaagactgtttttgtattagttggtagcaatctttccttcctatgttaaatgctcctttcaaaatctcttgtaatgcaggtctggtggtaatgaactttttcaacatatgcttatctgaaaaggatatttctcctttgcttaggaagcttagtttggctagacatgaaatttttggttgaagatttttttctttaaaaatgttgaatataggctccccaatcttgtctggcttacagggctttagctgaaagatctactgttagcctgatagtgttctctttgttggtaacttgccctttctctctagctgcctttaacattctttctggcattttaatcttggaaaatctgacaattatgtgtcttcgagatactcttgtatagagtcttgcagaaattctctgtatttcctgaatctgactattggcctctctagcaaggttggggaagttttcgtgaatgatatcctgaaatgttttccaagttatttgctttctccctctccttttcagggatgccaatgatttgtgtagatctggcctctttacgtaatcccatacttcttagagggtttgttctttcatttttattcctttttctttatttttgtctgtcttacttcagagaactagtcttcaaattctgagattctttcttcagtttggtttattctgctgttaatacttgtgactgcattgtgaaattattgcattgtgttgatcagctctgtcagacctgttaggttcttttttataccacctacttcgtccttcagctcctatattgctttattgtgatccttattttccttggattgggtttcgctgttctcctgaatctcaatgatcttcattcctatccatattctaaattttatttgttatcccagccagttcttattggagaactggtacagtcattttgaggccatacaaaactctggtcatttgagttaccagagttcttgcattggttctttctcatttctgcatatgggtgttcctttaactgtagtatagattgattacagtcaatagacttctggatgttttcacctggctgaggccttgtgcagggtctctatctgaagctgatttcttgtctctggtttcacaggggggtatgttagtgaggcatttttttaagttgaagctttgtggtgtgatccagtaggtggcatttaggcttacgggtcagttggtggactcactcagttgtgtagctcccctatggttccccacagtggcagctatatttcctctcaatcctctgggaacgtggcttcctctcccccttaagtgctgactgtagatcacggcttgtcactcctggactgcccactgtagctctgggatgatctcagcatttatgattcttccccatctcagaggcagcagaggaagggaccttagtagtggttttgaccaagggtcttgtgcttgtctcctgagggctccacccgaaagatggaagatgaactgacctcctcttcttaaactgactgcagcctgttggaggtatggataaagcacttaaagcctttgttccttcattagtctgagggcagcaagggcagttctactgcagaggcagtggcagggaagctttcagttgcccctggaggctctgtccagggagttgctgagttgctactggctcaatagctctggcagtgggtggctggaagccctggagaacctgcccagtgaggagatgtgggaataggcacccatttgttctggccagttttccatagggctgctgtggtatgctggggtccctctgcagttcctagttgccttgaattttccagtacgtggagatatcatcagtaaaggctgcaatacagcaaagacagtagcctgcccctccctctggaagctccatcccaggaaggtatgggcctgttgccagcccaaaagtgcctgtaggaggtggctggagaccctggttaggaggtcccacctactgaggaggaagaggatcaggaacctactttaaaaagcacactggccatgttttcatagagcatctgtgctgtgctggggctctgcttcagctcccagtcacctcagacactccaaaaccacccaaacagcaaagacagtggtccacccttcctctggaaactccatcccagtgaggtttgaatctctgtcagccaggaaacactggtgagggtagctggagaccctggttgggaggcctcaccaagtgacggggaatgggattggagacctgctggaaaatgtagtcttgccatgtttttgtagggaagctgtgttgtgttagaggtccacttcagactcgggtcagcttggactctccaaagcccaaaggctggaaaggctaagttactcaaacagcaaaaatggtggcctaccccttccctggggagctccgtcccaggaaggtgcaaagctactatcggtggctggctggaattccaagccagtgggtcttatcctgtgagatggccgtggatgcggggcctgcagactgtagctcatcagccccctggattcagtctctttcctaggggtatatatggggtctatcctcccgctttgcctgagtttcagctacttttcctaggaagcccagatagcctgagaatctagggcttccaggtctctggaagtgctgactggctgctctgacaagactccatgtaactctatgtgtcagactgaagggcctggtggagtgggttcataaggggatctcctgacctaagggctgcaaagatccatgggagaagtgtgggttcccagggtcacacattcactcattacttccctgggtagggaaggttctcttggctctacgtccctcttgggtgggccaccctcttgccttctccattctccatgagtcaagttgtttccttgattagtcccagtgctagtacttagatgtttcagttgaaggtgctgtatttactttccccttccattcctctccatgaaagccatgcacactagctgcttctagttggccatcttggccacctccccaatgtgtgtgtcttctttggtgacatgtctacttagaactttgctcatttttaaatagaaaaatttgaccttttattattgagttgtaacaattgtttatatagtctagatacaagtccattaccatatatacgtttgtaaatataatctcccattctgttgactgctttttcaattccttggtgttgtcctttaaagcacaaaatattttaattttatgaagcctaatgtattcatttgttctcttgttgtatgtgttttttgtgttacacctaaaaaaccaatgccaaacccaaggtcataaagttttatttccaataaatctctgtctgacacacagagctaagtggagtcttggcagagcagccactcagtcactttcagatacccaggagccttccctctgacctggaggcacaactttgccctgaagaactgctaggctagttttctttttttttttttcctaagaattgcatagttgtagctcatacatttaggtctattatccattctgagttaattttgtgtatattacttataaatcctacaaatggtattttgtaaacaaaaatcatttgtgaactgggaactgcctataacacatgaccttttgaataacataagatttcaccttgacattaattgtgatgaatagaaatatgtcaaacaactgccttggtgcttttgttttgggaagtaggcaaggagggttgttcttcacaaaatctattggtaaacgtgtattagtaaaatggaccattcattcgggtgcgggcactttttaaaaaataggcagctgggctacaaaagttgaatctcgctacaacattcctattttgtatgcctgttggctatgcccagatttcataaaatttacatgtctgtattatgacatttctaaggtctcctaataagcaatattgctccttagtgagtagaaataacataaattactaatgatgtctgcatttttgatatataaatctgacactgtcagatgtttttgtcctagttttgttgcagcaaaatattgcaagattattcaagcctactgccttccctctgacctggaggcataactttgccctgaagagctgcttgttttctttttcttttcttgtattccagaggcaattgctgttagtaccaggtcttgggaaatggcaagcagaacatcaggggacccatgaactgcaggaagctggggggacgccagaaggcacagcacttaggaaagcattttcaatcagagcatgggttggtactaagaaagtggtgtattgttagaaccatacctttggtgccaaagcacaggtcagtgtaggttggtaagtcaaaagaaagggaaggtgtgatatggagtccaagaaggtctgtgtccaaggacaccagcccaaatggaggaaaaagtccatgtgtgaagtctaagtaagtacatgggctatggttggtatactgaaatccaggcaataaatacatcagagaggtttgtgtaatcccagctttgggaggccaaggcaggtgaatcgctttagctcacaagttcaagaccagcctcggcaacatggcaaaaccccatgtctacaaaaaatacccttagccaggcatggtggtgcatgcctgtagtctcagctatttgagaagctgagatgggaggatgacttgagcccaggaggcagaggttgcagtgagattgtgccactgcactccagtctggatcatagggccagactttgcctcaaaagagagagcaagagagagagactgagatagtgaggtctgctagcatgtataaccatgggaagaacatggagggtactcagactggccttgagggaaacaggtaaggagcggagttcaaaaaaagcaagaaacagaaatttggatcatagaaccccagagcagcataaccagcattacggctgtgagcttcttaaggctgggaattgtgtcttttcatttgttactccagtgtctaaaatggaccggagataaaacaagtgctcagtacgtgctgtggaattaatgaatacatgaatgtttctaataggattgaagttgtctgctcctagccttagttgtttttgtggatgtctaaggttgttgggtatgcacaattctctagagaggggaaggactctgtagatgattaaagttggagaccatagcttatggggtgcgctgactttggtccactgaagagtactcactctcaatacccaatagtcagaaacacagtggttaagacaaagagaaaatgcagtaaggtgcaagtttgcataaattaggaaaagagtcaagaaacgatgacaatttaggtggcctgaccgaagttatactaacgagcttcaacaatcagccattcacagagagtctgatttgaaacttaaattatggagagtagcatatttttgctatctctgccctcttacagcataaaagagagcttcaggtgagctgagatggagagctaatctgttcactgggtgtgtgggatgaccaacacaaaaaaattcctgtgttccttgcaaatgtaaggatttaatcagagaattctcaaccctgaaaataacagaccagaggatgatttgaaccagtgtcaggaacaccctagtctcagggactgtctactgctcatcagaactaactgatttaatccactgagaagaaatgtttggactcttacggtattataaataatatcatatttatattacataagtgtctgagcatgacaataaaaactcatgattggtaggagctgttaagagtgatctcactggatgtagcagtccagttcagtcatgaggagctcattactccctaaaagctataaaatgcttgttcaattaataaaacaaggaattgaaaagcaaaaacaaatatactaacaacaacaaagacaaattttaaaaaccaagcctctatgacaacacatacttgcctcaattaaacacgagaatgagattattacaattcactaccaacttaccagcttctccaaatgctaatcacacattctctgggaaaacttgtggatttacaagtaaagaaagtaagttccgagttgaaacctgaacatcctgacatttaatatggggagaaagtttaaacttctaaggttactcaacagatatttcatatgttgtcaaagcaaattattgacaggcatactcattgtgcttcactttactgcacttcacagagattgcattttttacaaaatgaaagtttcaagcaagtctattggcaaagtatcaagcaattctatcggctccattccagcagcatgtgctcacttcatgtctctgtcatattttcataattctcataatagttcaaatttttccattattattttgtctgctatgttaatctgtgattattgatctttggtgtgactattttaattgtttgaggtgcaaaaaccacactcttataagatggcaaacctaatcgattaatgttgtgtgtgttctgactgttctaccaactcaccattcccctgttcatctctccccctctccaaaggcctccttatttcctaagacacaccaatattgaaattaggccaataataactctccaatggcctctaagtgttcaagtaaaaggaagtgtcacatgtctctcatcttaaatcaaaagctagaaatgattaagctaagtaactagtaaatgattaagcatgtcaaaagctgagataagccaaaatctatgcctcttgcaccaaatagttagccaggtagtgaatgcaaaggaaaagttctcaaaggaaattaaaagcactactccagtgaacatgtgaataagaagaaaatgtcataacctcattgttaatatggagaaagttttagtggtctgggtagaagatcaaaccagccacaacattcccttaagccaaagcctaacccagaggaaggcccttactcccttcagttctatgaaggctaagagaggtgagaaagctgcagaagaaaagtttgaagctatcagagtttggtgtttataacataaaagtacaaagtgaagcagccagtgctgatgtggaagctgcagcaagttgtcaagatttagctaagataattgaggaaggtggctacactaaacaacaaattttcaatgtagatgaaacaaccttcacccacattgatgaagatggaagaacatgtcatctaggactttcatagctagagagaagtcaatgcctggcttcaaagcttcaaaggccacgctgatagtctactgcagctggtaactttaagctgaagccaatgctcatttaccattctgcaaatcctagggctcttaagaattatgctaaacctggccaggtgcagtggctcaagcctgtaatcctagcactttgggaggccaaggcgggaggatcacgaggttagaagatcgagaccatcctggctaatgcggtgaaaccccgtctctactaaaaatacaaaaaaattagctgggcgtggtggtgggcgcctgtagtcccagctactcaggaagctgaggtaggagaatggcgtgaacccaggaggcggagcttgcagtgagctgagatcgcaccactgcactccagcctgggtgacagagcaagactccatttcaaaaaaaaaaagaattatgctaaacctgccctgcctgtgccctgtaaatacaacagtaaagcctgggtaatggcacatttgttgacggtgtgatttactgaacattttaagcccaccgttgagacttactgcttaaaaaaaaatctattccaaaatattactcattgacaattcacatggccatccaagagcctgatagagatatataatgagatcagtgttgttgtcatgcctgctaacacgaccaccattttacagcccatgtaccagggagtaattttgccttcaagtcttattatttaagaaatacagtttgtaaagctctagttgccgtagatagtgactcctctgatggatctgggcaaaataaattgaaagtcctctggaaaggattcactattctagacgctattaagaacatttgtgattcttaggaggtcaaaaatgtcaaagtgaacaggattttggaagaagttaattctaactctcatggatgactttggagggttcaagactttgatggaggaagtaactgcgaatatggtggatgtagcaagagaactagaattaggagtagaaactgaagatgtaaccaaattgcttcaatgtcatgataaaatttgaatggacaaaaagttggttcttacggataagcaaagaaagcagtttcttgagatggaatctactcctggtgaggatactatgaacattgtttaactgtaatcaaaggacttagaatgttacataagcttagttaataaagcagcaatagggtttcagaggattgactccaattttgaaaggccttctcctgtgggtaaaatgctatgaaatggcatcatatgctacagaaaaatcttttgtgaaaggaagaatccatcaatgtagcaaactttattggtctcttatgttaccaaattgccacagccaccttaacctttagcaaccaccaccctgatcaatcagtagccaacaccgaggcaagactcttcactagcaaaaatattaagacttgctgaaggctcagaagattagtatttttagcaataaattaaggtatgtacattgtttttatacataatgctactgcacacttaacagaccacagtatagtgtaaacataactttcatatgcactggaaaaccaaaaaattcgtatgactcattttattgcaatatttgctttgttgcagtggtctgaaaccaaacctgcaacgctgttgaggtatgcctgtatttctttggaccttctaggcttattatatttctaccatttaaatttagctttaggaattgttgcattttaacttcagtatcaagtttctattgaataataaatacttcaaaagatcctggagactctgagatttggaatttttaataaaagctacgtttgcctattaatcatgtgtcttgaatgcttggaataaagaataagtagcgtgcattatttttcatgtgctttaaatatttcaaagtatttttaaaacatatcatttcataagtatataatatggcatattatctaataattcataacattattatagccacttaacccctctacgccttgaatttctcatctacaaaatgagaataacggtatgacctcagtgttgtaaggattaaatagctaatatatgtaaaccaatttcaacaaattctggcatctagtaagttttcaatatgttattattataatactgcctaatatgtatccatacacaacacgatttggaacatcctggttaagttcaggcatgtgaaaaatgcatgttttcaaattaatagcctagattttatttgcatatttgtcagtttataatgaactcaatctagaggtgacaagtcaggatagaggatacatagcacagcattgatggcatagactctagagtcttataagctggatttatatctcacttctgacacttagctgagtgaacttgggcaccttatttaaactttctgtgtctcatttttcaaggttgtaaaatgaagttcataatagtatctatcttctaatgttatggtaaagataactgaattaatatacataagatatttagagcagtgaactccatataagggtttactactattatatctactattatttttcagggcctaccttcaagtaaataaaagtcacatatcaagatatttaaaataagcaatgagactaattccaaagacaaccaattttgaccctgaatatctgtatcctttttgttaatttggttattcaaaacaaggcaagtgtctctcagagaaactatagaaagtgtccttttttcttttccttctataaatacacctacatcaagttggaatatttatttaggattttctatatcatgagataaagtaatataccagctcccaagggaggaggaacttgaggtttatcatcagagatgataaaaaccacaaaaagcagcaccctcattacagagaaatttgtaacaggtatactcagattcctaacccatttaaggggtgtatttgctaaaaaatgaatgcctaagccttggggatttcagtgcctgcagccgactctggagattgaggtatctggaaacccatcacagatcttccttgacaactttttctaccttttaaatatatgaagaccccatcctcaacttcttctttttgtaagtactctccctggtacatttcatacacagtcaatggcttcaacactcactttcatgccaatgactcttaaactgatatcttcagcctttctcctgagtaccaatcctatattttccattattgactgggcacttcctcctggagtcccacagcactttaaatttccaaaatgcattcattatcttctttccaacacctgttctttctcaataattcccactatcatttaatgacactcctagactgtccaaattggctcaacaaattcatacccacccatggactctaggatgttcaaaaaatggcttccatgcactgaactataccttcaaggactctcttcaaactccaaaacctctatcttcacatcacagaccattctatttttttgtttgtttgtttggttttttttgagacagaggagtgcagtggtgtgatcttggctcactgcagcctctgcctcctgggttcaagcgattcccctgcctcagcctcccgcgtagctgggactacaggtgcacaccaccacgcccagctcatttttgtatttttagtagagacggggtttcaccatgttggccaggatggtcttgatctcttcaccgcatgatcctcctgcctcggcctctcaaagtgctgggattacaggcatgagccactgcacccggcccagaccattctctttaaatatggttctaggtctacccacttcctggtctaaatgaggaattttgaaccccaggatctattgactgctatgaaaactcaacaggttttgtaattctgaagttccttcttgaaattacatgcaaaatgccatgaatgtaggtaagttcatttttcttagtccttgaactgcattatgctttgcaatccatctgtagtctatggaccgttgactcaccaaacagattcactactcaaaacaaattattgactctcgcttttgaaagagatatcagtccttacatatacacatgggcaccctactgttattcataaagaaaaataatgatggtcaaatgtggcagactgccacagttactacttgagaccatcactgtgacagtttctactgttactacctgagaccgtcattatgacagttactactgtcactacttgagactgtcattacaagactgaacaaagggacaaacgcagaaatgaaaacttaagacaaaagaaatctgttttaaagaaagggccaggggaagaagaagagagctccctgcttctagtgagcaagggcagccccctcctcccggagcttctacagccctttgtatttattgggtaacaagagcaaggaggcggcagtaacaattggtcggctgcttaattgatcacaggttcatattattaccaagaggcttcagatgtacctaatcacaagaaacgttgcacttggggtgtgactgccctcagcactccttctgggtggcatacacagtttgtcagtttgccaacattccgcatttatgagaacagtttgctgtttactcatatagcctccagtggtatactaagttaatcacgaccctcaatcttttggcctccaacagtcaaatctctgccatgcatcactggccacagtgtagtcatcctttggggccattaccagtttctctgagcaccaggctttagggccttctctgtcataccattcttcatgaaataagatgtctggaatagctttaacctcatcttcatccagggagtggaagacagccttccagatatgtctttatcagtgtgagttcaccgtgacatcctctgggctctgcaacataccaaccaatgtccttacatgataagtagcattttgagtggccttggagtaggatctattagtacttaaaacacatgctaatatcttctcctacgctgacatctcatggacccctgggcagcacttaattaccgatttcagaactgcccccaaatcaattgtaagagcatttaaagattctggacacagtatcattagccatgcagtctatgtgatagtgaatgtattagcttcctcttgctactataacaaattaccacatacttaagggttaaaataacacaaatatattgtcttccagttctggaagtcagaaatcctaaagtgaagatatcattagggctgtgttccttgtgaaggctctgggaccgaatctgtttccttgccttttccagtttccagaggctggctgtatcccctgactcaatggccccttctttactcttcaaagtccatcattccaatctctgcttccatcattacatgttcttcctctaactttgacccacccatctccctcttgtaaggatccttgtgattacattgggtctacctgcttaatccaggatagcgtcctcatttcaaaattcttaattgaatcacacctaaaaagtcccttttgcattcacaggtttgggaatgcttattatgtctaccatagtgaacaaggtggcagtctttttagggtaaaagccttcccttatttctgttactaagagtgttaaagatatctaggtttaccagttactatcgtcagctcactttctgctttttcaccctgacatctccaatactgacccctttgagaaaggtgattttttaataggtggaagatgatgcagtgttttgtcatatttctctctgctgtgactaaaccttgctctgactatgcacggtctcactggtaggaccatataccttccccaggtgaatcctagtctctcctcggcttatttagtacaaaagctaacctggataaaatttaatacctgatttggtaggtgggcccagtgtgctagacacgtgtaagagcagaaagtagattggtgcagttgcaacagagtgagcaaaaggtagaatggtttaaaatgaggtcaaagagcagccatgaatatctgaggacttggactttactctgcttgatgtggaaagctactaaatggtttttagccaagaactcccctttccaatctatgggaagcatggggatagaacaaaggtgaagtaatagaaaacagcagactattgccagtaggtgaaagattttttttctacaggtgatgagaatgtattgaaaaactgagcacaggtatgaaataaaaatatttacatctataaagaaacaccctggctgctatgagaagaaaagactaatagaggtaaggatagagggtaggagatcagtggagaggctattggatagtccaggggaaagaagatggtagattggactagggtgttagcagcagagctggtgagaaaacaggtggaaagcactcagaagagagtgctttctgatgagactattgtattttaaaagctttttacatggactgatatgtaatctaatttaatccttctaaaacacatatgagttagatactatgatctttatcattcagatgaataaactgatactcagggacgacagtttctagaacacacagagacaaagccaggactgaaatctacctggcaccaaagcccaccctttccatcatagttacactgactccaattctagaacagatacactgcaaaataacccagcatgggttcaaagtttaagttaataaactagtagaaaattggtggtagtattgactgctctgttaggaaagagaaaatatttaacagaggatgtctggggttagtaacagtttatatcaatgagaaaatattccagaagaaattggcacaaaattaattggctgattaaaatttctaagaacttatgcactctgaaaagagaaatcatattattaggaaaaatgaagtctatacaaaagaaaaaaagttctctcaaaaaaattctcaagaaaccttttaaaaaacacagaactcgctggggtcacccctgtaattccagcactttgggaggccaaggtgggcggacgacctgaggtcatgagttcgagaccagcctggccaacatggtaaaatcccatttctactaaaaatacaaaattagctgggctggtggtgcatgcctgttaatcccagctacttgggaggctgaggcaggagaatcacttgaacccaggaggcggaggttgcagtgagccaagattgcgccattgcagtccagcctgggcaacaagaatgaaactccctctaaacaaacaaacaaacaaacaaacaaaaaaccactgaactcaaacatttatcttaaggaaattagcaaaagatggcatataatataaaaaatgttcatcacaatacttctataaaagaaaaatcatgaacacaacctaaatattgaacaatgtggaataattaaatacaatttatatatatttccatataatggaatattacacagccattggaaattgtacattcaaatatactgaaagctatggaaaatgtttgtgctacaatattagttttttatgatgagattggcgtgctgcccactgtgctgaggatgaagatactagtttttaaaagatacaaaaattaaatataaaagtatctattttgtgaagatatggacacatatacagatataaatgaagacagagacacagaaagagaataggagagaagagagggcgagaggaaaagagaatgagaacatagcaaaatacattgaagtgaaacattaattcggaagatgttaagcatctttttgtataatttttattcataaacatctattatactcataatgagacctttatataaataaatttaaataatatggtgaaagcaatgctaagagggaggtttatgtagcctttggaaagtgagctcactctaacacacagattcacacaggtttgaactagtgcattcatacaaacatgggagctgcctgagcctgagatggcaaggtccatcctgtcaggagaagtggtggtcttcctgaaggcagccctgcttgcttttctccacagtccaggctgctttactcctaaagtcatttggcataaccctacaagtttacaaaactcacttaagatgctctctgtacattttcattatggtttattttttctcattgttttgtaggtgtgatgccatttgagtaaacaatcaatcacatgtcaacaaatttgtcttcttgggatttgccaacatccaacctatagggcttgttcttcttggtcttcctggtcatttacctgactactcttctggggaacagccataataggacaagactgaccctggtagccactgtaataacagccaccagggtcagtcctgtcctccacgctgcaatgggttatttccccagcaacctgaggttcttagacatcttctgtatgtgcaccactgacccagtctgcattgaatattccacatatataaggtcaatatctgcttcaccttctttaatattacagggttagagatttacaaataaaactaagaagtgtaccacatgccctacaagaggggatgtcaacttttagtacttcagtcacccttttaggagtgctttatccattcttataactttaaaactcttatgtctgcaactctcaaatttatttttccagtctatacatctctcctcggcttaagacttagagatttgactgcctccttgacatctcctcctgaatgtctagtaggcattacaaatttactatgttcgaaatgaagtttttggttttccctgctctttatctgatcccctattcatcttccaccaattctcaaactatattcagcatgcaatccgtgacctaatgctgtatttctgaaggctatcccttctaccctaccacaaacctgggcaagccactaacagtctttgctcagattcctgtaatatttttcccatggtggtcaggcgcagtggtctgtaatcccagaactttgggaggacaaggcgggcaggatcacctgacatcaggagtttgagaccagcctggccaacatagggaaatcccatctctactaaaaatataaaagttagccaggtgtggtggtgggcacctgtaatcccagatacttgggaggctgagacaggagaattgtttgaacccaggaggcagaggttgcagtgagccaagattgtaccactgcacttcagcctgggcaacaagagtgagactctgtcttgaaaaatatatatatagagagagagatatgtatgtgtgtgtgtgtatgtatatataatgtgtgtatatatacatatacacacacacacatatatatatatatacacacacatatatatattcccctcataggtttttctgattccactcttacgtcattgtaattcattttctacaaggtagccaaaatgatatttcaagaatatcaaccggaaatcacatcaccaacatcaacaccaacaccaacgccaccaaggtacattataatcaaattgcttaaaaagaaaaacctctgataaacaaagtattgaaagcaatcataggaaaagacattatatacagaggaacgaagataagaattatcacagagttcttgtcagaaacaatgcaagccagtaggcaatggaatgatataaagttctgaggggaaatggtcagcccagaaatctacatccagtgaaaacattaagcactttgggaggccgaagcaggcgaatcacctgaggtcaggagttcaagaccagcctggccaacatggcaaaaccccatctctacaaaaaaatacgaaaattagctgggcgtggtggcttgtacctgtaatccaagctactagggaggctgagacaggagaatcacttgaacccaggaggcagaggttgcagtgagctgaggtcgtgccactgcactccagcctgggcaacagagcaagactctgcctcaaaaaaaaatgcagctgtagtgagttttacttggaactttattacatattcttggttttagggccagaacatgcataattgggtgaaatcacgtatgtgaagtattgtagcctactaagcctgaagttctgcaaactctccttctctcttacaatagagccagcagatttttttttagtgagtaaataagaaaacaatacaatcttatgtgtctagagcctcataacatttttgaatttctttactttaaaatattcccatttttataatattaaaatacagcactattagctgtaatttaatgagccaaatactttgaaagcacttcccccaaatcatctcatgtactcgtcaataataagtttgtgaatttattatgagctctcatagaaggcatttggatgtccatacttacgcatatgggctctgtcctggagatgaagttcagaagcacttagactgttagtagccttattatctcacaaggttaagttagtgaaatttagcatgattgtaactgagctatgttctggctctgggggtactccagatgattcctgaggttattgttcctcctgtctggtacctgcaagcctctcaagccagggagataattccttattataaatggtcgaggtacctgcattccaccaatcagagctccagcttccttcctttttgtgtgcattccaatccatagtgaaagaaataagaaaggccagggctgagaatggggaagattgactagaaagagaaaggagggagctttttgggcaatggaagtgtgagagagagagagagacagagtgtgtgtgtgtgtgtgtatgtgtgtgtgtgtatgtgtctacgtatatataaaatacaacatatgtaatatatatatcttattataataatgtagccccaataaagttgattttaaaagtatgcttcttaccttaggttgtaggggttctatataatctggctcctgcctctgtctccaaccactcctgtctcctgccactctccatctatctcatactggtcttctctttgctccgtttcagttacagggggtcgctcttttttgacaaagcaaggcctttctttcttcaaggacttggcacttgatgttccttcagcctggagtgctttctcctagctcttcctatagccggctcattctcattcttaagattaatctcaaatactcctttctcaaagaggttgcctttgccattttaatatagccaccccctcccccataccactcctcctaatgccttgcttggccttcactatcatgaagatgaacatgtaaatatagatcttccaaacacgaccaaatgattttgagaatctgtttatcaataatttgttactttttaatgctgattagtattccattgtataaataaaccacactatttttatccattcaccttttttgatagaaatttgggtcatttccagtttgggacaattacaaataaaactacaataaacatttgtgtgttttgggggacacatttttcatttctcttgcaacattgtcactcagaaaagacagatatttgcaaagtttctcatgttacagaacactgttaccatattctgaactgccaagtacttttgatgggagatgcttgtctttaaataacattaaacaaataataatatttgaatatccaagaaatatccagattgaaatggtgaaagacagaataatttatagacttggtcatttttcctagaaacatgacctcacaattttaactgttagtataaactgatagtataaacaagcattttaaagatcactttaaatatcattttaaagtaacagtgttccatatggatatctacggaaaaatacataaattgtggtatattcatacaatgcaatattaaataagatgtgaacaaactaaagctacatgcaaaaaatatagataaattttacaaacataagagagatcatgtgatacttccggttcaccttatattttttcaccaatggtatacagcatataaagttctctattttcaattaaagaaatggcacatctataggcactaacaaagaggtagctctaaacaaccatattatatcacatgacccttcatcccccaccacatattttggacagtagatgtgtgtctgacccaagagcagtcaatccataattaaagcaaacacatgtaatccatgcttagtaaaatgaaaacaaacacaagcaatttgcacccagtggactccatgcttagtacaaacactacaaataataacaagttctgtcttgagaagtttcatagagaagatgtttctaaaggggccttgaacaaaggacaaaagaaacgtaaatatgacggaggctgaaaatgaaatatattgactcacatcagtaaactagcaaaagggaaacaaagtatacttcagaataaaacatataaccaggaataaagaagggtatttataaggatagaaaggtcaattcttcgagaagttatacctaagcctaaatgtttatgtactttaaagagcatcaaaaactgacagacctgaatgaagaaacagataaatccataatcataatagcaatttcaacatcctttttaatcgctgatagaaaaacaggtgatgatagctttaaaaactactacagaacaccaaaggctgtgagtattccagctaccaaccagtagtggatctttcattcccagcaatgggctggtgatccagttccaaaatccttgttagagtctgtttcctaggactattctcaatatttactatcttaagtcaggttcctcaggaaacagagtcagacagagattggtgttcccagagacccatctctggaacatcacggtaaaggcagtgagaggggtagggttgggcagacagagatgcagtgccgagcatcactccactgtgatggagccgtgacagaagcctctgctgatccgacatggagctgcaacgactcttcagagttgtctcaaactgaggtaatggggctgggccttttttctgtcacatcaaccacgcattggagaggaagtgcctcaagtaagactgttatcttaagcaagacaggtccctgagggcaattcttaaagagggactttgctgtgagctggcagagaactgcctcagttctgagggggatgtggccagcacatcacagcagtcactacataaagatctgaagtttagctttattatgtttgaaatgcctattaaacatctaactagaaatgttaagtagccagttgagtataagaacttggagctcaagagaaaggctgggctagagacaaagttgcagtcaacaatatttgggtgacactttcaaaaccttgaggctaggtgagatcaccaagggaattcaaagagaagcagttcaaaacctgaaccttggagcacttcaaagttaagagttaaggaagagtaggagccacctaaggtaaatgaggaggaggagccagtgaagcaggaagaaagctaagagtacggtgaccaggaagccaagtacaaaaagtgtttccagaaaagaggaacaatcaatgatgtcaaatgtggcagacaggtcaagggagatgaggactgagacttgaccattggatctaaacatgtgaaagtcactggccgtcttgacaagaacagttttggtagagtagtgggggtgcaagcctgactggagtgagtttacaagagaatgaaaagagaggaattagaagtattaagaataaatgagctgctgggtgccgtagctcacgcctgtaatcccagcactttgggaggccgaggcagatggatcacctgaggtcaggagttcgagaccaacctggccaatatggtgaaaccctgtctctactaaaaatatttttaaaaaattagccaggcatggtggcagatgcctgtaatcccagctactcgtgaggctgaggcaagataatcgcttgaacccgggaggtggaggttgcagtgagctgagatggcgccactgcactccagcctggcgacagagcaagactccgactcaaaaaaaaaaaaaaaaaaaagaatgaataagctggttgtggcatttactctaaagggaagcaaataaatgtgatgtagctggaaggggaatgagattagaaaagaagttttacaaaggataaataacaagaggaaaataattagtcaaaagaaacaaattgataatgtgggagaaaggggataatgctatagtgatggccttgagtggaggacagtgtatgagatggcgcatacttggagaggttggtctagttaggggcacagacaccaggtggggaggcagaatatatggcagttagtaggagtattgggtaagttctttgattactttgattttctcttcaatgttggaagcactaggatcagctgaaagtgaggatggggaggtgttggagatttgaggagacgagagagagtatacaatcatcttggagagtgagaaagtaaatggaagagagatatagtatgataggcgggcagcgttaggcccacttgaggtttgtggtcattaattgaaaatgggaggaataagcatgattgtgcttctccactgcagttattcatctgtaaaatggggctatcagtgcctttctccgtcgggttgttggaggatgtgaggattaaacatcttagtacaggtaacatgcctggtacatatcacttaatgagtgttaattattgtcctgtagagtacattgttatcttgtgtacatatctctgttttgatcacaaataagtggactcatagaactaaaggttaaaaatcatcgagtccaaccacttacttgataacctgaatttcatctacatcctcattcggcctttgtttgagctgcttagggtagggcacatattctgtcccaaagcagtcatttcatctttggacatctcaaataactggaatggtcttccttctttcatagtgaaatttgccctgtggtaactttcaccaaaacttacccattgggccacactgaaaaaatcatccttgtctatggttccatctctcctacaaacggcactcttcatgtttgactatagagcagacagcattctgtgcagccggtctcaaccttttcaatacaccctccaacctttccttccttatcagtatcatttgcatttgcagaaggaaaaaaaagtctatttttcaatactttcaccccctggagccacattcttgttaaagtgtctgactttgttaccttgcttttttctgcagagaaaagtggataatctgcttttttctagtctagaacaattttcctttactgcgttttgtagaacactgtaagattctaacgattgtttcacttaaagacggtttaacacaagcaaataattttgaaaaactgtagtcaaaattgcagttttctcatgttgaaatagctaacatatactatcaattcccaaaaaggtagctgtagtgcatttcctaaatgtatttgttaacaaaacattttgttgttcttgctgctcatttcctggaactagcattccacagaataatctttgggaaacactcattcagaaaaacgtctcttaaacttaactaacacatgacatataaaatgttggcttatattacatgtattataaagttgcataaatatgcacaatcataaaactaggtgttaacgccaatctttatgcttatagttcttatataagcaactatataactataaaaccaaatcaatttataaaataaatataagtaaaacaaatgaacttcaatataagcaactatataactataaaaccaaatcaatttataaaataaatataagtaaaacaaatgaacttcaaatcgaccacattaagttaatgtgatatgtaatattgctttgtttaaacaaaatcaccaatgcagagtttattgataatgacataacatattattattaacttggttcttttttattttgtacatgatacacttgcatttgaatcaataatatgattgctgatcatttcagttttttaaaaagaaactcataaccacaaatttatttttggataggtcaatcaattaaggattcacttccaaataaaatactataattttaaaaaactttttgaacaaaaaaaattattgtatatttattttcttctgttgaactgtatcaagttggtatgaacaaagaatacaagtaaaacatttaaaatattaataccatatgaatgtactcactatatgcacagattctttttttttttttttttttttgagacggggtctctgttgcccaggctggagtgcagtggagccatcttggctcactgcaacctccacctcccaggttcaagcgattctcctgcctcagcctcttgtgtagctgggattacaggtgcctgccaccacacccagctaatttttgtatttttactagagatggggtttcactgtgttggccagggtggtctcaaactcctgacctcttgatccacccgccttggcctcccaaagtactgggattacaagcgtgagccatcgcacccggccagattctttaaagtctgacatttctattcttctgtcacgtggttgtgatagtcgttctcccagcgcttttactttcttgacctagtgcaaaaccttcattcacaggacactctaggatattatttagacttcacttggcagaaatataataatagacgcaaactcaggcactaaaactgggtgaccatattcagtttttaagataattatctataacccagaaaatttttatattattttcagaaattattataaaagtggaaccaataatgggaaaatagagatgaggagctgctgaaatgtccataatgatctttgcagagagtgtggattggcagcctctctttttttgcacagggatgaagagaaacagctcagccgaagtctccagcactcccttttctcctctacagttctccacccacccaccggcccaaaacacacaggaaagaaaactgtcaggtatatttttacattcctcacaccagtgtgtttcttccatttgaagctgtaaggctttttaatctattattgtagaagaaaggcttttcctctcattaaagggaattcaagttcagactccctggactgatagaggattctggatttggggctggagaagatatatactgtgattttctccttagaatttaagctatagttcgggataaaatctaagctaatgctaatctaatctgaactctaacctccacttgcaggtgtagggagtgtgatctgccacaagacaccccaagttcctttttcacagtgccctgtcccctgtaccagagttgtctccagccttgtgctttctccctgcttgcctctcctgtttcctctaggggcccccccttagtcctcctcacccttcacccttcctgcccaaggaggaagaaattcctctaggaccatgcttctgtggaactgggaagtggtgggctggcatgaaaaagaaatgaaaggcacctcatctaaagagaagctcaactcctaagaaataacatgcttgcaactcttggatgataataaacacactaggacgttgaagattacaaaacacagaacgtggtctccaggtccacactgatgatctttaactacaaaaaaaatagtgggcaactctggttcagctaaatgggaatatgtcttaatggttttctctggatagtaacctctttcatttacctgcatttcctaatctgaaaatctctaagaggtcaatattccactgaagtcaggcatggaaggatccttgcctcttcttcaagaaaaaagaaggaaagataaataaaactgcactctgggactaagagcatgcaactcagatacttgatacaaggcatgctccgaattcctttctgtatagtagtgttcacagttttttcttctcatttttactttttaatttcttaacttttttctcagttgttcaacaaacgtttattaagcccctttcatgtgatgggctccctgctaagtgtttccggatttaaagaagaaaaagattggtgcctgccttcgaaggactttcagtctagagacagacactatactataaactataaatagccaagttaacaaataatttgcaatacataatcattccttaacttgttcagagctggtatgcccatctacatttcctttattttttattttctgttataatctccacagagcaaggctcaccctggcctgcccaggttctgcagagcttgcttacaatctttcagagaagggcattcagcatagctgcttttgataatgaagatatggagctttatataatgacaactgatccatctatagattgcaagctctttgtgcaggcctgtgtctaattgtccattttgtatagcagctaatccactgggaaaataccttaagtgttttaaaaaaaaaaaatgtgtagcaatattcccctgctgccacctggtgctttatttacactaagttacactctgaattctaggtaaggcagcttaaaatcatttaccacactcaactataaaatgaaatcccagcccctcaatacacacgcaagcacatacaaatacatactgatcacacatacatacactccttcattccttccatctctgctagcccagagcagacatttcttcatgttttgaagaaatgctactatgatagccagaattgaatcttgagaactatgttcagttaagactagagaataggactaagatagtgtaattgaaaaaactttctgctaggccgggtgcggtggctcacacctataatcccagcactttgggaggtcaaagcaggtggatcacctgaggtcaggagttcgacaccagcctggccaacatggtgaaaccccatctctactaaaaatacaaaaattagctgagcatggtggcatgcacctgtaatcctaactacccgggaggctgaggcacaagactcccttgaacccgggatgtggaggttgcagtgagccaagatcgcaccactgcactacagccttggagacagagtgagaccctctcataaaacaaacaaacaaacaaacaaacaaaatataactttcttctttcttctggatgacaaaattgtgtgctatactgacgagcctgtgtaaagagttaatgaagcaggccgggatcatcagctgtcagttaattcatcatgaaatatttttgaagacccataattcaaagctctggagaatcagtggtgagcaagaagaataccttctatgctcaaaaggaagttatattctagtgtggagagtgctgttaagctcctaaacaaatttttaaaaatcaggcaggagtaagggataaaaaatacataaaatatggggctatgactcaggcgctgcttccgttagtgggggcagggatggcccctcagaggaggtcacatttgggactcgaggcaatattgatcatgaggaagacagctgtgttaaaatctaaaggaagagcatttcaggcaaaaaaatgacagcacaggccccacgaagagaaagactttggtatcttcagggaaggcgggaaggccggggtggccagagcaatgtgagatgaaggaggggtgggtggagaaagactggctggtgagcgtgggagggttggagcaggagtgccaatagattagggatttgatttggttctgtaagcaaaggcaaaaccactagagggatttaagtaagggggcaacacaatctgtgctgctcttctgaataatcactctgaaggatgaattccagggggaagagtagaagtccaagacctgttaagaggctatggctggctgggcgtggtggctcacgcctgtaatcctaacactttgggaggccgaggcaggcggttcacaaggtcaggagttctagaccagcctggaaaacatggtgaaaccccgtctctactaaaaatacaaaaattagctgggcgtggtggcacacacctgtaatcccagctactcaggaggctgaggcaggagaatcacttgaacccgggaggcagaagttgcagtgagccaagatcgcaccactgtactccagcctaggtgacagaatgagactaggtctcaaaaaaaaaaaagaggctatggctgtcatgtcatccaggtggaaagagagtaaggtgttacagtagcagacagtagagatggaagaaattgtcagctttgagatatattttataggtagagcgaaggggtttttggaagacctagacatggggatataactgaaagaagaaaagtaaatagggctcctagagcaactaggtagatagtggtaccattcactaaggtgggaaaggccagggttggggaatagacctaggaggaatggggaataaatagctctatttggccatgttaagtttgaaatagctgttagatttccaaatggagcagacaggtagatactaagtctggatctcagggaagaggcccaggtcatatgtgtaagaattgtcagcatgtaggtggctcctaaggccatgcttgttcaccttactctaccttaagctctagataatatcttttcctaacccctctgtcccagcttcactgaaaggcatgttcccatcagcaaaaatctcaaagactgaatggaatggtaaaactctgccattctaaagaatcagctccatgcacatgcataagacagagttgcaaggcctcttccaccaaacccctcatttacccatgataagtttggggtgcagagaggtgagagacccagtggtgtcaatgcctagcattaccagggcttaaacccgatgtgctggtccacaacacagcatcccttcagcaatcctgttgccgccaagatggcctgattatattagggctgtgggatatgaacaaagtcaggtacatgcacataccatgactaaatttaaaattacaattttaatctatggggagggttcattctttatcattcaaaggtgagtgagagtcctaggcatggtatagaacaaacagaaagcaaagttttaaaaataataatccctctgaggaccaatgaggctcacgtctatctccagggctcctctgagccctgcttgtctttaattcatggtcagtgaatgtgaacaggcattgaggccccaggtgccctggcagtctgcatcaacgctttgtgaataactgccctggaaaggttaggtaccacttggttcctgcaaagcaccactagagggctgcagacactagcagtggctggtacagccagccactgaaaccgaatttgagaaccgcgccatcgcctagtggtccaaccctccctgtaggttgaggaaattagagcctcagaaatattaagtggctctcccaaggcctcccggctggttagtgacaaagtcacaattccaccacagttcctctgatgcaaaattcagtgtgatataatggaaagtatatgggttttagagccaagaatcccattttgctgtgtcttatcttgggtgctcagtgaaacttcctaacttctctgaacttcagcatcttgatctgttttatgggtgatgagtgcttctgccgtgccatgtgttctgttggtacactgtcatagttgaggggcccggcacttagtgaacactcagccaatgctgtggccttcacctctttctgctgaggccaggttcttctctaagatggctcaacctcaagaagcaactttcaggaatgaactcaaatgatgcagtctggttacaatactttgctgcatgttggagtacacataaagagaactatattgctttaaaagacacaacaaataaatacaaccataggaggtacatatagctttagttgaacaaggaggcatggaaaggaaaggggcttccttgctctgtcctaaggtttagattcccagcatgtcctttcatgcacccccattcagtggatatttgttgagtgcccattgaaggagggacctgggcatttggggaggacacacacgaatcctaccctcagcaagaaacaacaatttcatgccaggcttttccctgtaactttatttatcttacctcttggattctcacgatagtcacgccagtgattattagtccttaaggattcatcaacagtccctcatgattttagagatgagaaaattgagtctccgaaaagttaaataacttgtccaaggtctttcagaaaatacggagaagctctggagtttaagcccagctctgcctgagctttcacagcactgcctgtgccctattcctggaggtgtaaggattgaggacgtgggaagtgctgcaacaggaaggctgctgggaattctgagcagcggcccctaactgaggggatccaagatggcttcaggggaagctcacactggcctggggaggtgggaagaagaaattcctgccacaactgtatatggtaaatcagatgcatcaaaacatggtgtgtttggtggatgaaggagaacacacacacacacacacacacacacacacacacacacagagttagggctggttgaattccataaaagaattcttcctgaaaggaagtacagtcaaaagctgaagtaaaaaatctaaagttagatttgtaacaccagtatacctcactaccagcttgcccagaaaattaatttcatgttccactgttctattaaaaaactctgactgaaatgtcttcacaaggtaaacaataggaaagggtccaggaacttcctaaagcatttaacacagccaaaggctgacctgacctaattggtgggaagtaggagggaggccagggaatcccagctcccttccgcctacccaaggcctggcacactgccacttagaaatactaactagcccagtggccacgttcagcaactgcagggccgccccatctggccccttgaggtgctgcccaccagcatgtttgtcattgtgagcatcttctgaacatgaatgtccagatgctcttccaaagcagttctagaaatagccaggcgcctgaataaagcctgacacaggaaacatctttccatccaggacaaagcacactcctccagggaaaggagagaggaagtcataattagaatcattcattcatccaacagaactgagcctccagcaaagagccaaatgtaatttttgactctgactgcacattggaatcacctgggaacttttaaaaaataccaatgccgcagctccaccctaaaacaattaagtaagaatatctgggagtgcagcccaggcctttgtattttttaaaagctctctggatgattcttatgtagttgagaactactgcattaaatattatatacaacaaaaaacagagtcactgaccaggcctcaaggagctcacagtttcacagagccctacagtttgcaatatgtttattcctgccagtgaccttggttgatagtcacaaccagtctgggaggttgttgttattgcctgttttgcagatgaggcagctaagcctcagagagagtatacagctgcccaatattacacagcaggtaggcagcaagtgagcacaagaaccaggttttctaattccatgactcctgctctcacatcacagaccaacatgtagaggaatcggaccgaggagaggctcaaagcacttcataactgcagcatggcaagagtcaagagccaaaggaataaatcgaggagagtcttaggtggacctacctgccctaactaatgtccaccaaccagctgatgtccattagtgttcctaaaactgtgcctgcgttgatcaactacttatttaactcttctcattaagaattttctaggcaacagaaccttgtggatagaattttaagcagacacttaaaagatcaccttgccaggctccacaattggccttcggatatgctaacaacccctaagaagaatacaatttattgcataaattctgatactgtgaacagtaagtacttagtacagtgtctcaactgatttgttggccattaattaatggtcagtaggtgttagagggagagcccatgttagtaaaaaggaaaagggaaacaggtgcagcatgtggctaagcagtgggccagaacgcagaggctttgaaatctaattcccttctgggtggctgtttagccttatgtaaacccttgcctctttaggttacatatacagttttgcctaacccgaagtgggctgtacattcccatggcctcagagatatttagtctagtttcccaagtgctggtcctttgggaagcaggaattactcttctcaaacagattttctacccctgccctttccccttcagcaactgtgatctggctcttctctgtctctcttctaaccccttttcttcctcactcctggtgtttgtcaaagggcagtttccctgttcaccacttggaaatcaccaataaaatgcaacccttccattttgcagatgaagagactgacatccaaagagagaccctggccaaagccacctagacagtgacagagctaggaccagcccagcctcctggtcccaccccagtactctgtcaggacagaaacaaccaggaccataaagcatttgtgagtgtaggttccattcccaatgctaactagagcaactcacagttactagactcagcttagtggcctttggatatgggtccaactgtgggaaaaatcacgatgaaaggaaatgtagtctgataaccccttgcctctttcaggtcaagatgaaagtacttagatgggttagtaatgtatgttactaacacctcagtatatgcaaaatccatatctgttttttaaaagaggatccaccgggagaagaacccaaagaagtaagtctctgataacagcatttatggtctgtgatatctggattcagttgaccttcttggttccttccataacagtagtaaggatagtaataataataccctacctaccatttactgagtgcccaatatattccagtggctctgaaacaggcttcatgtatcatttaatgctcatgtgaagcaggtcttattttctccttatacagttgaggaaagtgaaactcagagtgggtaataacatgcccacgtttccacagtttgtaagcacctgagccagggtcaagtctgggtctttataccacatacataaacccctcctcagaggacctcagtcctaaacaaacatcgagaaattttggacatggcaaaggccacacatagatacaaggatgcataagagagagaaatatcagtcctcaaaggctgagcattctgcagttggctttgaactggttgcccacccatcccctggaccattcatcttcccctcagtcatggaccctggaggctgtgagggaagcaagcagcttgagcactgtctggtccaacactggagggaagcctgatggctgtgacattcatcaactggttaatttcagaaaggcatccatttgcaccagctgcttaaaaagctcctggccctcaggagacactcaaccaatcacaaagcaaaggcagggagtgtttctggtaaccacattcaattgggtgtctgtctgctgcttgatgggttgtataatttcagcaaagcaaaggacagtggagaatagagttaaaatgaatgatcttatttcttttaaattattattcttatatttatgactcacatttgtccttaatgcacaagtgccctattaacctatcatgatgatgatggtcatgatgaaaatgactgctgttgctctttacacggcgagagatgcttggctgtctctgacaaattctccctaggtggctgcatcttgtgtgtgtgtttggagggagaggtgagggaaagtcaccacaggtccagggtctcctcctgaactcagtcagttcaagttaaagtctcaagtaagaaatgtcttataaaaatgattggtaaaccagaaggcaaacacattcacatagacaaggagagatttcccaccacttcccagagttggtgttgaggaatggggcacttcctcctagttgtcagttcccctcatgagagcaaacgctctatgatcacagatttgaaataaagtgcatgggatgttcttaagaaaccatttctcctcgttggggtgaagatgaatgaagagaaaagcagtatgattatttcaatcaatgcataaaatggatatgacaaaatactgctccctcttatgataaaaactcacagcacactaggaatacaagggaatgtcctcactctgataataagtatccacaaacaaattaaaactaatcatattaagtggaaaaacactgaacgttatcatttctattcaacattgtactggtctgtgccatatactgttaatgtcagaaaaataattaaaatgcattgcaattggaaaggaaaaaataaaatagtaattatttgcagtgacatgattgtgtgtgttgacccttcacagcctcactctatagttaattcttatcgggacctctcaatgtggcaaacactggacaacaatgatctcacttggtcctgcactggttatctctttcattttactagtggtgaaggagaagcctagagagggcagtaccctcattcaactccaggtttgtctacctacaaagctgaagctctcaactgccccctttgtcccatctctgtaggtttagagctacttaaagagttagcactgtgtgtctatactcaaaagtaccttctccctctgtagtattgagcacttctaatttttgcttactcattccttttatagtctctatgtaatccaccagtctggctgcatttgagagtttatatgtttgttttaaactcaatggtttattaaagttaagaatgaagactcagtccagaaaaataaaatatatatacacgtatatatatatacgtgtacatatatacacacgtatatatatatacgtgtacatatatgcacacgtatatatacgtatatatacacgtatataaatacacacatacacacacaatagtagaaagaagttggggattatggtaacagggcaggtaggtaggagaggacagaacataaatctgaagatgctacattcactcattcaacaataaataagtgtgaaacatttactgtgtgccagctactgaatgcttagaactgacaataaaaagatgaggtctcagccttagcgccatcttcttggaaacctctgtgccatgagagccaagtggaggaagaagtgaatgtgcaggctgaagcgcaaaagaaagatgaggcaaaggttcaagtaaatcactagtctgtgcaccagtggaggccgcaggagtagaaacatggaatggcagaggctggaaatgctggtacaagttgttgaactgcatggatctagagcttctctcaatggatctagaacttcatcgtcatctgatcaccgagactacctctgaggctcaccttgctcataacaaaaactgtccatgttggtcctttgccccagacctgtgacattctggactatttctgtgttcacttgtggctgagtgaaagagccatacgataaattacctcttactctgtcttagctgaagagttaacaaaaaaataaaaaaacaaaaagatgaacaggactaagctataccctcaagcttcccgcagcatagtacgggtagaagtgggaaatagttatgatccaatgggtattttggaagcaaaggaaaatgcatgacccgactgccaaagtccctgagtagggaagcagggctgggaagatttcacttgccctttaaaattatacataatatcttctattagctcattaatagcaccataagatgaaaaaaagttcatttttttaagtccatgcttaggacaaaaaagtcttaacacaagtatttagaaatatcgccttataaatgaataatgaaatatgctgaggtggaataaaaaataataataaactaactatattagtccattttcacactgctataaagaataccacctgagcctgggtaatttataaagaaaggaggtttaattgactcacagttccacatggctgggaagacctcagcaaacttacaatcatggcagaaggtgaaggagaggcaggcaccttcttcaccaggcggcaggaaggaggaaagaatgggaaactgccatttatagaaccatcagatttcatgagaattcactcgctatcacaacaacagcatgggggaaactgccccatgatccaatcacctcccaccaggtccctccctctgcacctggggattataattcagattacaatccagagatttgggtggggacacagagtcaagtcatatcattaacatttattaatgcaggcactagtctaagctctttacatgtattaactcatttaagcctcactagaaccctaagggataaatatcaatactattcccattttacaaactaaaaattgactcacaggttgctacacatggccaaataacacttattatctattatgtaactgatcctaaaaggaggtagcaaggagtagagagaagagaacaaactttaattagaacaaggctctgccacagttagctctgttgatttgggtctttatgggtaaagcgagtgggttggtagataacttatgaggctctttcaatttcaagccttgaaaatccttcttaactttattttctatgggaataaggtaaggaaggacaaaagatgagcagaggtgagaagcaaactgaagccaccagggctttggaaagtgtcactggaactgcagcagagttaatacaacagaactgatgcccagtaggtggtcaggaaatagatgctaaacaaaatgaatgtatgaagggaataactagtgaaggaaaaacaaaatcttcactcagagatgttaaagattgatgccatacaatatagcagaaaagaatgtaaacactgtgtttataatagaacccccagtgggactgcagaggaagaagaatgacagacactgatcctgtggtttcatggcagggttgtcaagagcatgagttctggcatcagactacttcaagtccagactctgccactctttagtgtggccttgcgcaagtcactcaatctctctgtaccttgttttccttatgtataattcaggaatactattagcactttcatcatagagtcgctgaaagataaattgagataatatacgtatagccctggcacatggtgagagcactattaatttaggcattgttattaattctgaattggtgtgagtgagacagacaagtaggaaataatgattgcaccagtattggtatcttctcatcatatccagcctgatttctcctcgaaagaagttgtggcaggggcaaaaggatgatgtaaatatttggttaatgagattactgacaaacatggaaggaaataagactaggaattgcagacaaagggggttgaggcattacatggattggtgcataaagggctccttaaaaaagccagcgaggccgggcacagtggctcacacctgtaatcccagcactttgggaggccaaggtgggcagatcacgctgtcaggaaatcgagaccatcatggccaacatggtgaaacactgtctctactaaaaatacaaaaattagctgggcatggtggcacatgcccgtaatcccagctactcaggaggctgaggtaggagaatcacttgaactaaggagtcaaaggttgaagtgaatcgagatcacgccactgcactccagcctggtgacagagcgacactccgtctcaaaaaaaaaaaaaaaaaagacagcgaactggagctctccatctcctccaagggcaggtccagaagaaatgagcttgcttcccaacagaggggaagactgtcctaataagaaattaagaatagagttctaaaggaggaagaaaggtgcctgtttgctactttgtggagctttataatgtaaatagaaacatattttggagctttacatacattcttatcctactgaaataaggacttaactaaggccaaggatgagttggaatgaatcagtattccaagcctcaggcctaagaacttagcattgttggcattctttttcttttttttttttttttttttttgagatggagtctcgctctgttgcccaggctgaactgcagtggcgcgatcttggctcactgcaagctccacccgccgggttcacaccattctcctgcctcagcctcccgactagctgggactacaggtgcccaccaccatgcccggctaattttttgtattttttagtagagatggggtttcaccgtgttagccaggatggtctcgatgatccgcccacctcggcctcccaaagtgctggggtaacaggcgtgagccaccacgccctgctgcattgttggcattcttgccatagctctggttctactttgtcacattcagcccccacttgctgagcacctactgtgtgccaagcaccctccaaggcctcacaacctggtttatattccagacgtcctagctggcctttctaaagcaccataattgtgtacatgggcgtgcaatccccattcaaccttaattctcctgctcttctccaggagctgatttctgactcacaaactcatacccaagtcagccataacgccgatgtacttccctggtgtgtgcgctgaaggatgggttggaggaggcaacagtgacactggttcagatattgaaagcctccttagggtctgggcctctgccctcgcacctagcaaccagggccacagaaatcattagcacagtgcactgatttccttctatttctcgggtgctgagaaatgaaggtaaattaaagagaagacgcgtataaataggccactttaacaagtgatcatattcacacccaggaaccacaataacaaatcggaacaacagagaaacatagcgcgctaatgagaccggaaggctgtttcagtttctgggctctgctcacttgtgttttgaaagggcgaagcaactcagttgcaggaatgtcctgggggagaaaattccaccaggacggactattatcaagttgtcacggaggaggtgggaaaaggctgccaaagagagtctgactcgtagactgctctcagaaggaatcaatgctgggtctgatcagagctcatcctctttcatgctgcctgattttttgagaaataacgcccagggttacactgcatcattgcaaactcaccaggcagccccagtcagagctagagaccaggcaggggagagcaaatgtaatctgaccctaccacctgctggctagctggctggagggcgggtacggaaggcaggccatgtttgagaatctttgttgaggctttgcttcatccccctccctcccccatcctcccacagaattgcttattcctctggcaaaaccctgattctcagtgccaagcttctccatgcataaaataaggatgataacatttgttttccactttttcagtgtcttgtgagacttcatctgctaatatttataaagcatctcaaacttcttcagtgaaaggtgacaatctgtaagcaccttgaactgccattgacaactgacatttattgagcatggacttcggatcagaccgtgtaccaggtaatttatatacatgttattcaattcagtcctggtacaacagcctggtaaagtagatgttgttattcctgtctggcaaagaaaaggaaacccagaaatgtcaagtaaccttgcctaaatgcacacaggtaaaaagagtcatgattgagtctgattcaaagatttcccaatatgtggctcagcctctctcatacactttgctttgaatctcctttgattgtgtgttcatttatccaatgagccgctatgtgccaggcattctttccctatctttcatcatctacccttttccatgtctctgtgtgtacgtatctgtttctatgtgtctttctccaatttttgtcacacacacacacacacacacacacacacacaccgagccaggtggagaccagtgttctcatcctatagcccagttatagggcacccagcttttctgggcctacgccacaaggtttattaccctccactagcaggggcagccccatctcttggcacaaatcccagggacccccatacctggcgctgcttaggggtccagttcatctacctgaaactgagtgagctttccttggcaaattctgaagaagttttttcattcattgtttgctacaattcatttgacaataaatcatatattgctttgtggcagctcttccattgttgccttaaacaactgttcagcacttaaatttttctcatgtttatgtcttgttcctggaagcaagagtcgtgtcttatgtctctgtttcatctgcagtccccacaggcttgacacgtgagaggcattcaagaaacatttgttgattttatattcaacttcctcccgttcctgggaatgggtctgcctaattacccttcctgacaaattctgtgccttgctatatattcctatctccccataccccatcctttctttctatttttatttttttcattccttcctctcctcagttaactaagcagaaatcatggagttaggtttatttgttaaattatcttccttgggtcctataggtggaaagaaaacaaaatttggagtctgacaatctgagttcgggtcactatgtgacaacagagtttactggctgtgtgtcctcagcctaactaccgaactcgtctgaaaatccatttctcccaaaattactatctccaggtcttcctcatctcagaccatgctcctgaaacataccttgcaaaggtcatcaatgtcctacctacagccaaatccaatagactgttttcagcctttttattttgacctcagtacatttgtctttatttatgtatttattttttgcagagacaaggtctcactttgttgcccaggctggccttgaactcctgggctcaagagatcctgccatctcaagtctcccaaagtgctgggattacaggcgtgacccacttcacctggcccatttgtccttattgaccagttttttcttgtctcaacactcttccctcatgccatcaacttcatctcatgttcttctgagtactctacttggtttttttcattgttatcattcttcttactacaacatgagctaaccttaattgatgcttactatgtgccagaattgcgataaactttctaggtactgctccgtaaggtaggtgctattactgtccttgttagagatgaaaagaccatggctcagagaggtgacctaacttgcccagagacatatggccagaatatactctctcaacagaacaacatgcttcttcaactcctttatgggttctccttctcttctttttacttttgaagttccttggagctctatcctgggcctgtttctcctctgtctactctccctggcaatctcagctacttctttgtctttaataaccaaccatgtagcaatagttccatattgccatcttcagcccatgctcctctcctgagatccagatctttgtcttcaactacttactggacagtgtgatacatgatgtttccgacatgacatgtcttaaactgcattagtcaactctccctcaaaacctgcttttcctctcaggcttcctacctcagtaaagtcatccacccactgccatccaccaactgccatccgccaactgcccaagtgagaaagctcaatgtcgtcttctttacctctcattcatccttcttaacatggcttccaagacccttcaagacttggttccttcctctttccagtttcatttcttccgattcatcccctgacattcttcatccagctgtgatcaccaaagtgtgggtcctagagtaaggcaaattcacttgcttgctttctctgattttctctgaccttctcgtgtctgggtctgcaataaattgtacctctagctgtaacatgcttccatctcttacccctcacctaagctcatctttatttactaggtctcatcttaaatgtcacttcttttgaaaatacttgcctagaccacctcagatcttcctgctggctgtgcccagctacccttaccgaagcataatcctgtcaatggcaattacttttcaactgttgatatagtcttgtctattgtagtatctccagtatccagcacagtgccttgtgcataaaaggctctcaaaatatgttgagcaaatgaatgaattataaaatagagttagctaaaactacttctcagtaacattaggtaactgtggaaattatgagataatatgtgtgattatactttgtaaactgtaaaattctagaacaaactccatagtgataaaaagaattatgcatggttgatctcccacacttttccagattcttcatcccctttctggacccactatctcctcaatagccaagagatcttgatgtatcaaagtcccataaggggactccagctgagattccccccaggttctctcactttgaggcttctttctgacccaggagctacttaggtaagttgtcttccatatcatctctgtcagttccatgctgaacttggctcaatcagcagctactgacaaaaccactcttccatacctatacctctgctctggcccaatccaatttggttctttaagctgattctccccactcactttaccctctaatctgccaggacacttagtgactgaggattagacttttcactgaggattagtgtcttgccctaccaccccaatggtccctcttgctttcacttgctacagaaactttacgagagaaggacatcctaacctaaggttctcctggccatagagaagctaatttggagaagattacgatgttgatacatttttaaagcaaaccctcaatgagttgattactgagtgagggaagctgatgtgggtatgagaaaagggagacaaggagaaacaaggagtatctgtgagggtatgagagttgttgggggaggaggagcatgaattcgatcctccctggtgatgcactgtttcctcagtgatagcccgtctctccaacagcagggtaacttctctggctggctcccagagaatgggtgtcccattctcaaccagcatcacctaagacacacttggatacagggttgcttatccagaaccatccctgagtttagaggcccaaatcggggataatctcagtgattttttttttttaatcatcaccagggatatttgggaaagtcaatcactgtatcagctagtggtttcaacttataaaaacaaccacaattacaacagcaaaaacctctgattcactcacataaagagtgtgtagacgggccttcctttctacttcaacacctgctcctcagactcaccccctttgtgacttcttgaaaaatgccttgggtgttcattaacctgatgtaaccaatataaatatgttagaggaaagcactcaatgttatctgtcctggaccatccttgccagagaaggacaagctcttaataccataggagattgtttatctgaaaaatctaaccactggaagcatccaaggactgtttatacgctaaatttattttcttttttttaggcaatatgttcacatgtggaattaacattatctaaattccagagaaagtgctgattggacattcaaggtgaacagtcctcctttacagtccctgagctcaggcaccttcccttccctcaggcccttaatgtctctctcccctataggctcttcttcccttctggcttctgttgcagcacctctttctaccacacacccccatcctcagcccaacacagcattgcttacaaaacactcaaggtgctaaacttacctgcacctttgtgtgtttttactgcgtaatttaaggaagtgacagaactgtcataatgtgtgagtttaagtctctgagttttaaattcaacacaaaagtaaaacaaggggctcatgaagatgagaaaggtagcagacatatttcataatttttcaagatattactcctggagccttatgtttttttcctcccgaaatccttgcataacaactagacagaatgatgagcagtggcaccttggaaggcagccagtctcacagtattagagagataatacaattttagaactggaggggacctcagacctgatttagtccaacattctcatgttaagattaggacagtggggcccagggaagtgttgtgatttgctcaaggtcgcataggggatttggtggagcaaaagccctctgggcatgcaaggccatactatccagattcaggcagggcttgactggcagcaacggggcctgtgcagagagccagaaagaggcagtgataaagaaagtgaggctgcagggtgcctggggaaaagaagccgggaaggatcacagaggaagatgcctttgaagcacaatttcaaactaagtggtcaagcttgcaacatttggagcatgagggttaccagatgggcctgggatgggcagcaatcaggcactgggggattcaatgggagtcaaggcaaccagaagaagctgagtcaaagagactgatgtgcaaaccacatatggctctccatatagtagctacagctgcaaacccaaggtcagtgtttagatttacaggtgtgtggataagacttttggtcagggccgggtgcagtggctcatgcctgtaatcccagcactttgggaggctgaggcaggtggatcacgaggtcaggagatcaaaaccatcctggctaacacagtgaaaccccgtctctactaataatacaaaaaattagcctggcgtggtgtcgggtgtctgtagtcccagctagtcgggaggctgaggcaggagaatggtgtgaacccgggaggcggagcttgcagtgagccgagatcataccactgcaccccagcctgggtgacagagcgagactccatctcaaaaaaaaaaaaaatgacttttggtcagcatcagtcacctcagccaggtccctgaatcacagccaagcctagatgagtggtattattgaccatgataatgggaggatgaatggtggctatgactgcctgctgcaatcaacctttaggatggccagaaattctgatttggccagcccttggcccagacagcaatgtccccaagacacagtgatcactgtgaacagaagcagcttccatgacaaaggccacatacacagccctgtgatcgaggagaccactttgtcatgggtcagagctcaggttaagatagacctttgggggtgtggggaatggagacagtgaggagagcacagagctgcagagtggagagaactgaattgactattttcaaatcttatggattcagaagctgtcgatggagcagtagcaaaacattcgtgccactgatactaaaatggcaaatctctcaacaactttattgccagtatattcagaaggttttgtcagaaatcttgagtaagtgacttaactttgctgtgtgtcaggctaaatcaatgcaatgcaaaaacatctggatgaaaatgaagcatctctgtcagttgtctgggtgttttgtctacctgacatcaaacagctggattcttgtaaacatttcgatgatgcactaaatttttcatttttcactcagatcacaaaatcatagactctccagcttgacaggaacttaaaggtcatctaatccctgatatttggcatagcctcaaatgacctattttgtattatcacgcaaatcaaacactaagataggggtatgtgttctgtctaattacacacattgtatcttatttaaaaacatgtttaacatttggttctccttggctgtttaattgaattgtaaatgaatcatttacaggggaaactagattattatatgtataaaaatacaatgaaatcctgtaattaggccagacctgatctacaaaaaaagaaaaaaaactgcaggtgtgtaaatgcttgtgaactttggtgctatgttcaacacaaagccaagaggctatgtgagttaccgtcactcatagaactacctgcttagtttcacaaggagagcagtttgcaaagaagtttgctttagctctttttcacttcttacttattcctgccatttaacaagcttacaccaggtgtctgtttctagactgagacaagcaaagtaagggcaaaggactgtgaaattcattaactccagagatctgtttcagcatctgaatctttctcatccagatggccaaggcttcatcccaccccaaccccctttcatattcagagagttcctttaaaaacattcacccaatcacagcttcatagagaagacagctaaggaagctttcttacccatagattgagctcctggtctaaagtatgtgtttaatttccctgaaagtctgcacagagtttttcattttttacaaattgttctttgagctattgtctcatttatactagtaggcagcatagaaatggggacagccaaattaagatataggagcaaatagggagtattttccaaaactagataatgtgtgcatgctgagtgaaaaaaaaaatggtaatctggggagaaaaagttagaaggtccagaaaaaggaagaaagggtgaaatgaggtgatgagtcaatgaggcagggagatctatgaagactgttctggatggcaggagatgtagaaaagaaggttcttacatttgcagtgatgaaagcttataatgggcaagggggaggcatagtaaatcagtcagccagccagcagcatgtgctgggtgcccacagtgtacagagcattcttgatactaataactgcagggcgttatcgaggttgtaaaagaccttccaagatgagcttgaaaactagtggaggagaacatcacagaaaaaccacacctcactaaacttcagaggaaaccagaatcatattgaataatgaagatggctattacctaagcaggcatcaatacagccacatgcacaaaaaataattcaagcaatctagctagtatagatttaatatatatgtatgtcagagttaacatttatggagtgcttactatgcagcagacattgtattaagcactttatacacattacatcttttatatgggagatgtggacaagcctagaaaatctaaacatgtaatgggtctgttcattttggtatgaaatgaaatagatgaaaggatatgggtaaagatgtaaacacggactccagcatttaaggatttgacataactagctatgactattcatgggcaacccttaaagtaaaggggttaagttgtaattttctcagatttggattgacttatggtgggcaatgactctccttcagctttgggtagagaattgttcactaccactgtctacatctctgtacaccttgattgttctatgtgtttcattgagtttgtcttttttttttttttttttgagacggagtttcactcttgtcgcccaggctggagtgcagtggcgttatctcggctaactgcaagctccacctcccaggttcaagtgattctcctgccacagcctccccagtagctgggattacaggtgcccgccaccatgcctggctaattttttatatgtttagtagagacggggtttcgccatgttgggtaggctaatctcaaactcctgacctcaggtgatccgcccgcctcggcctcccaaagtgctgggattacaggcatcagccaccacacccggccaagtttgtcaccattcttttgaagttatgcttttctgaattatagggggacagtataaactattgtttaaccaagagtttaaagatttgcaaatgtcttcagaagtataaatattcacaaagggaaagtgtctcctgactttagagaaatgtagaagtaccccactgggtatgagtaagttctccagagtctctctttaacctagctctagggtaggatagaagtggagccagaagggtctgtgtctgcagttttgacagtgttacccttcttcagcctcctgcacagtgagtgacctccaaggattattcagggtttgggaacagagaattgtaaaatattttagatgggccaaccttttctcaaaatcctcttcaaaggaaaattagcctcttcctcaccattgccttctgtgctgaggaagaggacctgctgctccttgaaggagggtggccatttcgataccacaagagcctactctgccctttgactggatgcctggccaactcctgacattaaggcagcaagcaatcccagtactgcacaaagttctgcagcaacagaagtgatgattaaatagggcaatgggttctcttgggaatacgaactgggaaattccaaaaatcaatcagtatcatgagaaacatcaggaagaacacagaagagcagcccaggcatgctcgtggtgaacagcacagagatgaagggccacctcagtgttagatccttccagtgtccatatgacatttcactcaccaggatgccactggtgccagatgctcctgtgatgtgcctctctctctcatcgccacaggtatgctgcagtaagcccccactgactaaggtagcctgagggagtgtcagctcctggaaaacaaaaaatcaccatactgtcagagctggtcacttagtcagtgctactcaaagtgtggtccaaggaccagtggaatccaccactgttccagtgtgcagaaacaaagcatagaaacaaaatatgcatttggaaatctttaaataggaatttgaccttgccccagcatccaattttatgtctgttaaatctaataataaaaagttgagcttgcatttcataagtctatgggagttttttcatttcatttttctaataatttatttttattgtgttttacaaaagcatcagtcagtatgtgaaggactgaaaactgtcaaatatttaaaaactggtgcttcacaacagacagtttgaggagcactgatctagtcccctgtttacaaactgtgaatccttgacccattcgtgggtagtaacccattaaggagtcacgaaattaatttgtgtggataccagcattaacaaagaatagaataaaaagtatcagggtacattgcatgaatacaggattaagttcttttttgtgaaatttttattttaaaaagcatatgcaaatacatatgcacatacacacttgtatatttttgcatgtatataaaacagaaaaaggaacctgggatgcccatgttttattgtaaaagatacttctgcttttctaacagttgtaaggaaaatgtctgcacatatttggaaaactatgtgttgtccatcacacacccttctgctatcttttatctgatttggattctatgggagctatttcacaactttgtaaactgtagctagctgatagcattgcaaaataattattctctgtaaacattcaagttttgtcccttctggtagaggttcaattgattcccgctccctctgtggaagaagtcagttttgccctttttttgtgcattcaatattcttgatctatacatgttctttgtattctcttttgatccagttataatatctgcctagttctctcatagattgagttaaataaaatctctaacacatgttcatgttcaatctgtatgagtcatgattctatgttttgttttttttttaaattaccttttaacgtaggtcacagtagagctttcatgcatcaggtggcagtgtttgttcaaacttaggtcaactgtaatgaaatgggatacctcaacaggaaggcaaacctggatccctagcaaggcagagggacttcctggtttaactttgtgctgttgcctagaggaatcaaaaggaaggggagaattttattgtgaaagaccacatgccagcaatgattttaactgctgctctgtaagatccctcccacgccttgttctcatgatgtttgaaatacacatctcttttactacagttcagaaaaatctgaagatacaaatgaatatggactaggcaaattagaagtacgaggtctcagacatagcaagaaagaacaccagcctgagaacaaaaaatttaggttctaggcccaacttgatccctaatgagctgtatgatttgattttaagcatgtgacttagcttctctgggcctcttattctttatctgtacattaatttacttaagttggtagttttcaattctttttcaggcataacaactttttttttcaaaacaaagcttgtacacagttttaatgtgcaaaacaagacaacaactctggtttagtagggtgtctgcttggtttcaactcctccactatggtggcctctaattataggggcccctcagaactgtgaggattccaagatagcacggtctgagaagcatggaatccaagagcactaacattcttcctaatgctgcgatgttccagtcaattactttgtctctggtttaagagcattcaaaatcttttccaagttgttccaccctttccttccttgccccatccccaccctgttgagtatttccaattttagctctgacctttagagtccttgttctatcttcattcagttccttcaactgctgggatccaccccacaggtttggtccaaaacaacctatggggtgtattccactgtattctaattatctgtttaattatctgcttccccaaccagactgagtttcctgagagtgggtgtcttgtcttctcacctttgtctcccaggtccagtgcggtgcctcgccctcttctctattctcagtacacactgtctgagttcttctctctaccttacctatgtatgttctacccagatctctctcctcaacttcagcctctcttgtacaactactttccagacaattccactttgggtatctcataggctcttcaaaagcagcacatccagttctacagcttccattcagaatatttacctcctcctaaagtcctatctcaagaaaatatgctgcaacctacctgctgctgcccaagccagaaacccttgacacctcactttctttcatttccacttccacatccaaccctttaattccacctcctaccattttttaatccatctacactttttttagagatggagtcttgctatgttgcccaagctagacttaagtgatccccatctcagcctcctgaaaagctggagctacaggtgtgtgccacagcaccagcgatctgtctttccatttccactactgttgcccaagttaagatcacatggataataacagatcattttgatggtgcttccagggtgccaactgttgcaaaaataataaaacccttttcatacattagatccttgaatgtgcgtatctgctctggttattactgtagccccattttaccattaaggaaattgaaatttaaagagaataaataacttacccaagctggtaagggttggagctgagaatttagtccgtctctccaacgccaatactctagcccttacctataatacaacaactgaaatattaactggtgttgtatccctactatcagctttgccttccaagtcttttttttcccgttctacagcccagagattttttaaaaatagaaatcttactgtgtgcggaattcattccttctggtgggttcttggtctcgctgtcttcaagaatgaagccacggagactcccggtgagtgttacagttcttaaaagatggtgtgtccggagtttgttccttcagctgttcagatgggtccagagtttcttccttctggtgggttcgtggtctcactcactccaggaatgaagccgcagaccccggcggtgaatgttacagctcttaaagatggcgcatcacagttgtttgttcctcccggtgggttcgtggtctccctgacttaaagaacgaaggcacagaacctcgcggtgagtgttacagctcacagagacagtgcggacccaaagagtgagcagcagcaagacttattacgagagtgaaagaacaaagctcccacagcaggacaccagagggcagcgggttgcagcagctggctgggtgctccgcgtggccagcttttatacccttatttgccccgcccacatcctgctgattggtccattttacagagagctgattggtccattttacagagtgatgattggtccattttacagagagctgattggtccattttacagagtgctgattggtccatttttacagagtgctgattggtgtgtttacaatcttctagctagacagaaaatttctccaagtcccccactcgacacaggaagtccagctggcttcacctctccttatcatgtgtcctccacttaaaattcttcattatttttcctttgcccagggatacaatagaaatgtgttaatatctcactatgcccttcataatctgtatctggtgtcttttcttgctactgtcacccttggcttcagtcatactgaaccgtttatgatttggggggcatatattgcagtatcttccattcgtcctccatatcttctttttcctctgcttgagaaattctttatttcccccacctctttacccagccagctcctagttatacttcagttctcagctcagaaatgttcaactctaaagaaacactctgtgaccattcctgttcccagagcaccatgaatcttctgaagctaccattgtgactctacattataaatgcttgtgtatttgtctgtatcctcccccagtacaagttcccagagggagactacttctgatttattcagcattgcccattgtcttaacttgggttccttagaagcagaccctgaggtgagaattcttcttactcaagtgatttattgaggatgaaattcatatgagtgagggaaactggatagggctggggagatcagtcaagctgtgggtctagcctcagcctgattccagggggcactttggagcttgaataacatcacagagtcagcccacttgagacaaggggactgtgcttttacccccatccccaacaactgggcattggctgcaagctgctcctagagtgtgtgtgtgtgggatgaaggcagcataatctcccaggcatagctggggggagtgcttccctgctgcagggctccagagaagggtgcagctgtgactccttagtaactgggggatgcgtgctccaccagacaacaggggtctactacataccccagctgctagaacatgtcctaccacatcatactcaatacatgccaaagaaagaaatgagagaattttttcattcatctatttctcatttattcccagctgaatgatttttctagtggattacattctctaatattcccaatcttgattttttttaaagcctctcaattttcttccacctttcctgaacactaaccactttataagatttccaaacttgggtaactctagtttctcacctcatgtgcttcgtttagttctagtttctcacctcatgtgcttcattaagttctagacaaacatgagcacggccattaatatttctacaacttaattagttgtttaaggtctgactggttaccggtcaaaatgtacacatcttctcaaattgagtgggacttatggggagaaggtttctgtcaattaggagaaaatttgatttttttttcttttttttttgatggagtcttgctctgtcgcccagactggagtgcagtggcgcgatctcggctcactgcaagctctgcctcccaggttcatgccattctcctgccacagcctcccgagtagctgggactacaggcgaccgccaccacgcccagctaactttttttgtattttttgtagagatggggtttcaccatgttagccaggatggtctcaatctcctgaccttgtgatctgcctgcctcagcctcccaaagtgctgggattacaggcgtgagccaccacgcccggccgatttttttttttttagttttttttttttgagacggagtttcgctcttgttgcccaggctggagtgcaatgggtcatctcagctcactgcaacctcagcctcccgggttcaaacaattctcctgcctcagcctccccagtagctgggattacaggcatgcaccaccatgcccggctaactttgtatttttaggagagacagggtttcttcttgttggtcaggctggtctcgaactcccaacctcaggtgatcctctcaccttggcctcccaaagtgctgggattacaggcatgagccaccacgcccagcctggaaaatttgatttttaaaccgtttgtctagaacaatttgctccaaaatatctacatatatcctacctggggggtctacccagagagatctgtgaattctctgtaatccatgaatgcatattccaggctgtgtgcccttacctatggcagtcagctgccacctgctcagatggatggacaccagcagcctcctccctgattgggaagttagaccacatggagggaagacgacttcttcccacaagaaggttcccttctgctcgagtggactggagccctgagcttattcctcaaggaaattttctctctggaagaaatccaatcctatcagactcagacaaaaggtaaaagccttaaaggtagagatcgggtcctgttctttacataaaaactaacaatatctcacactcaactgtttagaagtgctttcacatattgtatctcatctgatcctcaataaaatcccacccatgagaaaactgagacacctagcagtcaagtgactcacctaagatcacgtagccaacaaatggtagagccgtgattcaaacccaggatctccgatgccaaatatgaaggtcttttcagagtaccctgctgtgtaacacaaggcctggcttaccatatgccctcattagcttttcgttgagttgaattacctacggcttctattattcatgtccagtgcaccccttctttagaatagataacaaaaagtagatgatgggctagtctgtgtcagctaaagcattgtgccaatgaggtccaggtcattggttcaaatcccaaaagaccagttacctttgtctcaaaatggcagtaagcttagttccgctgatacaggccactgccctaatcactcattttgcctatgagtcaacatcagagaatggcaaaaggatttggatagagcagggcaagttcattactaattctagagggacattgggaagaaaatcttattgcttttatttttgcccaggagaagggatagtgcatcattggacttagccacataaggctctgggttgatacatgtggagttgaattcagtgacttgagtggatctgacccaggaaggcatcatgaggagggggtgtgccaggctgaagtgagaaaaagggctgggaagaaatgaccagctggaaaggccagtccagcaccaccaatgtcttcaaacagaaggctgcagagataacttgaagaccttgaggagcaggaaagtgtcatggttctggaggttaaatttaaaatccagagccccaaataaaaccttcactcaggttctcttcttccattcctataacagcctatggtgctgacaaggaagcaaatgcttaaaaagtgcagagctcttattatctataattgttataccattcaatgcaatgaacactgacaggcctgttttgcatccactgctgtacaagctcctggggttggggttcatgaaatctctgaccataagttattatccaaggagtgaaatgatcgtagtatattatacagatcaagcaaaaataagttctatgtagtgactgctctgagagtttaaagggaaaagttggctatggtcagattcctttagaagaacttctcaggaggggactgagttagtctttgacgaattggcaggatctgaatctgaaggtggagggaggtggaaagaggattcatcccctgaatccagtgccccacatacctcctttgggcccaccttattgtttcagccattgctgtagcaaccagctgtgagcaagtgaaacctggccgcgccgtgtctttggatgcagagagcagtgttcaccttctgttcccggtttctttgccacatctgcctgcaagaacctgcttggccattctgatacacatgcaaacctgagagtatggggaagttatcacccaaaggacaatactggatcaatgggagcagacgctggtagattaatacttccctcttccaccctgcaggctgccaagtctgagatgcattctacaggggcttcatagccttctaagtaggattgagctctggttgcccacagtgacgatccgataaagtaaccatggattggcttctccttcttccttctttcagccttcacagaccccaaatgtcccaatcctacttcttagcgtaactcccccaattcaaccacctgtacaagcccttttttgggagggaacatggaatgaagttaaaaatgggcttgttgctttttccctatatccctgaaaagtagctgttccagagataggagaaagccgagcaatatggcacagggagaatgtgcagattctctttactacacctccgaagcccacaactggctcccgcatttgatcaatcctatggggacttctcttagagccaccaggggtctttagagagctccctgaagcctgagtgatgggaagcctcacacccatgtggtagggaacatttcactgagagtgacatagccaagccctcctctccttccccagttccttcagacatctgtgaaagtttgaaaagggttcttgcattcccaggcccaggactgcagggagggaggaagctgaccctcagcctccctgaaacatcctttgtgggactcccatccctaccacctctttaagttctcagacctcagcactgggctgggatcttcccagaaccaccagcccacccagccccagagtgtattcaccagaagccctgctcagaagttggcctgatcttagtaatagtcctgactctttccgaacatagatcatgctgagttttatgcctcacaagtgaagtgtgataacaagaacttggagaggatctaaagcaaccaaagggcagggcatggtggcccatgcctgtaatcccagcactctgagaggctgaagtgggagggtcacttgaagcaggaggattgcttgaggccagaaattcatggttacagtgaactacaagttgcattacagcctgagtgacagagcaagatcctgtctcaaaaaaaaaaaaaaaaaaaaagtaaaataagataagcaaccaaagggatatgagtttgaaaaacagctctaggctgcacccttagagaagcagggcaacttaccttctcgaaaaggcaggaagtacaagggtgcccactcagtccagaggaggacatgatatgagagactggggcaggacagaactttcctcttacgaggattgtagaaggccttgaattttgtggggaggtaagaggagaaagataattggagagcgtgaagaaaggattgttaaatagtttttttctggcaacatttttaaaagttcaggtagtttaaagatggctgaggcaatgcaatgcttggagagagcggtgggggtgggctttttcttcgcagcaatctctctggccctgagtgcccccgtcagattctacccttgtacacttgaaggcacatgaaagtgataaggagaagaagggagaggggacagcagagaaggaaaggtgagagaatgacattggtcattgctgtggcgcgcttcaggtcaccacagcctgcccacctgcaggaatccttacaaagtcttcccggacctgtaatatgggactctcttcagggaagcagtacggcctaggattaagaccattagcctgagagtcagacccaagggtcccagagctgtttataggctaaacaacccttgctccacaaatacttaacttccagggccagtgtttccttatctagaataggagctccgtgaagtctgccttattctctacaagagccctagagcctcgtattgcacctggcaatacatatttgctgaatgaataaataaatctataaaattagaataaccttattaccactccaaaggaagtaaaatcatgataaggaacatggatgctggagccagactccctggatttgaatctgggctcagtggcttccatcgctgccactttggcaggttagtgaatctttctatgcctctctgtgcctcagtttccttgtctgtgaaatggggttgataacagaacacctacctcaaaaggttaaaacaagttaacctttttgtggggttaaaacaagttaaccttttgtggggcttaaaacaagttaatgtatgtgaaatgcataaaatagtgcctgactatatgtcagttcactattgttataagggttaattgactaaatccagaaaaaatggtgagaatttcatgtttttttctatatacttctgaactattcaaatctcaatctctctccctctctctctctcgctctctctctctctctctctttgagacatagtcttgctcagccacctccctctaggctggagtgcagtggtgtgatctcggctcactgcaacctccacctcctgggttcaagcgattctcgtgcctcaggctccctagtagctgggactacaggcatgtgccaccatgcctggctaatttttgtatttttaatagagacggagtttcaccatgttggccaggctggtttcgaactcctgacctcaagtgatcttcccccctcggcttcccaaagtgctgggattacacacgtgagccactgcacccggcctcaagtctcttataataaaatgtaaacaggtattgttattaaatatttttaagcagttagctcatcacctgccacattgtaagctctcactaagtgctggctgtttttgttgtcattgaaaaaaaaaaattattctgatcttactaggtctgacagttgatgataaagccaaaagtttgtcctcaggatcaacttagaataggagcaggcaattgcaggctttaactgaagaaagatcctcaggaaaactgctattggcactgaataggatgagagtagtgggagctgagttggttgtaatgtttagctgcaggctagagaaacagacttgaacgggagaaaaacagtgccttgcagaagcacatacactgagtggaacttgttgtaatataccagaccaatttctttttctttacagtttatttccatttctagtcagggagctggttcaattcctcaagaagtagttacaaaacttctatttttttttcagccctgtcactggggttgtgggaaaaagaaaaaccgtacacggcagccctaactcttgcagagagaatatgttaaatcataaagcaagatcatatatgatcacatctcaaagtgtgcaaaacaggtaactgctacagtaagttaagacaagggagacctcaattcatttgttcatgctcacatatattcatttactgactcattatctaaaagacactaagcacccactgcaccgaaggccataagaaacagggagcttgggatgggttcccttccctcgaggaacatatgcttcattgatgttggtgtcaatctgtatgagaatagctccaatacagggcagaatgtgatcatgctttatgaggccacagagcttgcttggggtgagcattatcagagttgcctggttgagtagtctggtatggctttttgagggtggtgggacttgattcagactttgaaggcgtggtattagctaaacagatgggagtgaaggatggcatcccaagcaagaagacactaggaggaagttcacagaagcagggatgaatatggctgttatattattgattcatcaatgcactgaacaaacttttttttttgaaatatttgttatgtgcttgaaagatgaacgcatcatcattctttccctccaacagtttgtagtttaatgggggaggcaaactcataaagaaaaacgtctattacagtgtgataagtgtatcagccaaggtaggtgtaaagttgcatgcagaaggttctccccgggaatgagctgggggctcagtgggtgaggagggagccatggcgctgcaagcacaaagggctgcaaaggccctttaggatgcacattggaggaaggagtacaaaggccactggagagtgatgggaaatgaggtagttagacgggtagagatcagatcataaaggcacgttgagtacattctgtgaaatttgggctttattcagaggacagggcaatcactgaaagatttcatatgaaaggacatattacatttgcattttagaaagataataaataataacattgtcttacattatttacactatttagggccaactgtgatttaaacatcgagcctcacaataatgtctatcatctccagagagatgcatgcactgttgccccaagtcagttgagtagtaaggagcagaaagatgctctgtctcctgggccaaactcttaacccttatactctgctacctctgcagcgtggaggagggaggcaaggagatggtaaggaaagaggcaggagccgaagtcagaatgaaaaataatgaagccagaactaaaacagtaggggtgagaatacagagaaagaaacagaatccagaaatattgagtaagtaggctctaccggatgttaggattgattagatgtagggagaaatgtggagggaggactggaatggctcccaggttctgctcctctaagtgtgtctcttgtgaggctgttatcagtgagaggaactataggaagtaaaggaggtgaggagataatgagttgaggaagctgtgggactccatggcagagatcctagtggggagtgggatagacccagctggagcttcggagccaggaaagggctggaagaagagactgggaaatctgatggattggctggggcagggcgggctgattaggttgtaggaagctaagatgacaggataacatatggacttgaatttgaagactgtaaggagttgctaaggccttttgattacagaagcaacatggtcagtaacagcctttcaaatgtcaagcctcaaactaaaatatccaagaactgacatggaactttatttccaaccttccctccagtctctggtgaaagcaacacctcagtatggatggtccagtcccccatgctcagggtgaagaccaagttctggggggcttagcggacactggggaagggagctggtccttgaccactttccccctcgtgcccctgggacatcctcatcctgtaggtctgctccacaagggccccagccacagcacctcgtgagggttgcgagatctttcctggtctggaagtggtgaagggctggaacccctggattcacaagcacttgtctctttgctttgtccctcatattacctgatggatataggatgaaagatgaaaaggaatgttgggagatgaagcagaggtgggaaatattaataatatcttgaatattaccctgccatttaattaaaatcatattttgggaaaaccagttcacagcactggacaaggtctaatggaggagggagaggacaggggaacaggcagaccaacttagagactattgcagtaacggcagggttgtgcaggactgcgtaacttacagtgcactttgaccgctcatttgatcctcacagtgcctctgcaagttggccttactagccccattttacagatagggcaaccaagagaagttagctcaatgaggcaaaatcatctggctagcaaatagaagagctcaggcttaacaccttggtcttccaataaaaacctttaggagaaaaaataatcccttcctccagtacattcatcacctgctgcacatcccacaacaccaggctgcctctcgggaataaggtgctctaaacatcagagcctaaacgtgcatttggaggctctgtcttcagagaagatcccactgggaaacaagtctgcaccaccttaaaggattcctctgggctttggaagggatttcccacagagagctgcttccaatcataacacattgagccttctgcaaggtccctgtgtaacttaactgtagaggcacagtagaaagcccactccaaaaaccatcctctgttcctgcctaatgaatccctggtatacgctgtcagaatttaagaggcaggtgtcgctcccctgacgctttgaataggaacttgttcaaatcgtgtatcctctctaggaacagtttttcaagagtggtttataatttttcatctgcagcagtagtgagggggtggattcagaggaagaaggaggaagtactgacgggggaggcaggaaaagaaatgccatcctggatcagagctgtgaacgtcaaaggagaggggtgatcctcacctctggagatgagagactggaagagaatgcctgtgaaggtaaaggaaagaaagaacttagatgtggtaggtggagccttctctatggagagacacagaagaggtttctatttccccagatgatagctagtagtcaaggcttcctgccctcaccatcatcctctgcaggcatctccacgtcaaccaggccaggccgctcctctttctgccccactcagcaccctccctccaccttttctctagcttatgcaacccaatatctatacatttgttcatctggtttactctttcttgatcactctctaccctttgctctactccactgatcagaatcaaatttaagtgccaaatgccctataagtctgacctgaaactccagcctacagtggttcttattgcctgtaccagcagttctcaaaccctagcatgcatcagaatcactcagggggcatttgaaaacacaggtttccaggactctcagagtttctgattcagtaggtctgggccacggcctgagaatttaccttgctaacaagttcccaaatgactcttgctgatgcttcttgtttgggaaccactaacctgtaccattcgtttagccttaatcatgcactgccctgtgctgatactgtaactgagtatccagatgcagctgtgaacatatcaaaggcagttatgttgtaggtactgggctgtatctcccacaggacttagctagcatactcagagcaggtacccaaacccaatataatttattaattgttgtgaaaacttagtattggttttaggtaaaattaggaagacagtagattgtccacaggaagcttccactttccctccttcatttctcaaccaacttctgtgtcactcactcttcctcctccaagcgacccaggctcccctaaacataggcttgtcctaaatacccagagctctcccatttgcccctcaaagtttacaggcaaatctcagagaagcttgactgaggccggacgtggtggcttatgcctgtaaccccagcactttgggaggccgaggcgggtagatcataaggtcaggagtccaagagcagcctggccaacatggtgaaacctcatctctactaaaaatacaaaaaaattagctgggcatggtggcgggcacctgtagtcgcagctacttgggaggttgaggcaggagaaccacttgaatccaggagggggaggttgcagtgagccgacattgcaccactgcactccagcctgggcgacagaccaagaatctgtctcaaaaaaaaagaaaaaaagaagcttgactgagaagttaagagacagctgagtgtatgagcttatttaaatactgatggagagaggcgcgcagtggtgccagtgtgggaaagagagggaataatggcaggtgggatccacagtgcaaggagaaggattcgcttagacaggagcagggacacctctcccactgtagatggaaaaaggaaaagataggtttagatgcaagaataatgaggctttagatgctaggtgactcccagctctaacatcttgtgattccatgaaattaaattgccacggtgtcagtggcttaatatgtcacctctccctggcagagctttaacccaaggaaatgaatgtttcatgagaggctcttaggctatgggaggcctgccagtgggacagcagggccttcccagtggtcttgaatacctgttgccctgctaggcaaggtgggattgggaaaatgggataaatatatccaactgtgacaacgtaagaactacagcaaggccacagagctaatacattctggaaccagatttagaactctgtgtcactcaagcccgcagtcatctggtccacccagtcatattctgaccacctgaaattgcaagggagggctggaagtattaggaacaacttcttcctaacccttgggctagagacttgagatgacatgctccatcccagacccacacagccccagcctatctctggggctctaagaaacacctgatagtgacaggaataataacaacaataataatttatctaatgcctcctcaattaaactagcatgtaaggtgcctggtacattgtgccaaaatctggatcataggaagaagtcaacaaatgtaagctgtcatcctcctcctcctcctctttctcattatcaccaccttcactgtgtgccagtaaccatattaggtatttttaagtatattttttcctgattacaaaagtaaccagtgtttaaaaattctaacaagaaatgcataatataaaaagtccaagtgtggtgcactagaaagagaggaagcacataaaatagttactgacccattccctatattaatagttactgacccatgccctatattcagtcacttaaaagcacagcagactgtctatgtttactttctggttcttctaatactcactgggtggtcttatttaacttttctgtgcctcagttttcttatttgttaaaagagagcaatgatagttctaacatctagagttcttgggaaatttaaataagatgcgatatacataaggcaatgaacacagtgctctgcacatagtaagcagtccatataaagtggttattatttatattattttttaataaataaaattctccaagatccacatgtcagaagtaacccatattggccaggcgtggtggctcatgcctgtaatcccagcactttgggaggctgaggcgggtggatcacttgaggtcaggagttcaagaccagcctgaccaacatggcaaaaccctgtctctactaaaaatacaaaaattagccgggcatggtggcatgcgcctgtagtcccagctacctgggaggctgaggcaggagaatctcttgaacctgggaggtggaggttgcagtgagtcaagactgtgtcattgcactccagcctgggtgactgaatgagactccatctcaaaaaaaaaaaaaaaaaagaaaagaaaaaaagaaataatccatattgatagcttattgcatacttttcagactagatatatgtatatctatatatacattctatgagatccaaaacatatacactattttacatgtctttactcatttgacaaatattgtggatgattctttttttttttttttttttttgagatggagtttctctcttgttgcccaggctgcagtgcagtggcgcgatctcggctcactgcaacctccacctcccaggttcaagcgattctcctgcctcagcctccctagtagctgggattacaggcatgtgccaccacgcccagctaattttgtatttttagtagagacgggatttctccatgttggtcaggctggtctcgaactcccgacctcaggtgatccacctgcctcggcctcccaaagtgctgggattacaggcgtgagccaccgcgcccagcaaatattatggatgattcttaaaataatcttacaaagtacttattgatacatggttttgtttctattatatttcttctaaggttgcatctccacctcccaaatgttcagaggaaacctctgaatgggtggatgggtcagcaacctttttttctttttgagactgagtttcactcttgtcacccaggctggagtgcaatggtgcgatctcgactcactgcaacctccatctcccgggttcaagcaattctcctgcctcagcctcctgagtagctgggattacaggcacccaccaccatgcctggcaaattttttgtacttttagtagagacggggtttcaccatgttggccaggttggtctcgaactcctgacctcaggtgatccacctgcctcggcctctcaaagtgctgggataacaggcgtgagccactgagcccagccaggtcagcaaccttttttatgtgaaggaccagacaaaaacagtttaagctttgcagaccatacggtctccgttgcagctacttaatgctgtggttgtagtgcaaaagcaaccatagacaatatgtgaataaatgagagtggccatgttccaataaaacttttttttttttttgagacaaggtcttactctgttgtcaagtacagtcgtgccatcatagctccctgtaacctggaactcctgggctcaaaccatcctcttgcctcagcctcctgagtagctgggactacaggcatgcaccaccatgcctggctaatttttaatttttttgtagaaatgaggtcttactatgttgcccaggctggtcttgaactcctagcttcaagtgatcctcccacctctgcctaccaaaacgttgggattacaggtgtcagccaccatgcccaaccccaatacaactttatggagattgatatttgaatttcctataattttcaggtgccatgaaatattcttttaatttttttccaaccactatttaaaaatgtaataaccattctgagcttgctgtactgtgtaaaaacaggtggctggctggatttggcctgtaggtcacagggagcaaactagcttgccattctggagccaggttgaagattagaggggcaatgaagcgtagaagtaacatcttaatataacctccgtcccttttcagtgagaagcgccttttcctcttcttgagatgcacgatcccaccacacctgttaaaatccccctgaagaattaaaagttgctgcctcctcagagtcctctcagcacttctttatagtatatactaaacactgggtgtcccccataccaaaattcctatgaagcctcaaactccttgcgtgtttaatttactgctgttcatccagaactagcacagtgcttggcaactgagaagggttgggttgaaccacaaagcttcactttcactctattggtgcaagcaaaaggaatccattagaaccagtctagggggagggagaaaggggaatcatttagaactaggaacatcttagtgtgcctaaattcaggaaacctccaccagggcttcgggcttcattctgtctctctctctctctctctctctctctctctctctctctggcttgggccacatggattcttatctctttgtctctgagtgggtctatttcttttttttttttcctcatcagttttatcagttcaagaactaatagagatcaactagcttccgtgaaccctacttttaaatatctgggagaaggccaggcaccgtgactcatgcctgtaatcccagcacttagggaggccgaggtgggtagatctcctgaggttaggagttcgataccagcctggtcaacatggtgaaagcccgtctcttctaaaaattcaaaaattaaccaggcatggtgatgtgtgcctgtaatctcaactactcaggggccgaggcaggagaatcgcttgaacccggaggcggaggttacagtgagctgagatcgcaccactgtactccagcctgagagacagagctagactctgtctcaaaataaataaataaatttatgggagagagaatctgattggccagggaaactggtcatacagtataaatataagtgcagaagcttaactgaacaggtagtctagggattattttccaaaaacagagggaatgtgttgtgcaggcacttcaaaatgcctataatacttgctggcttcatttatttcatgatggctgtgtcatggttactagtgtacatctttctcttttctactatctagatgaaatgctcctttagaacagggaaaaagtcttcctcattttggtgtccccagacctagcacagtcttttgcacgtaataggtaatagcaaacacttattgaactgaatgaaaaacactaccttctattcagcctttcatgcatctttcatctttatgaaaggtacacattccattgctaggcaaaagacatggtataaaagataaatttccttttcctggcttcagtactgctttttattaaattgtctttagctcagataattgcattatttccattttaggttttcagaggtcaaacaacctcagatccagatgtactatgaatgcaactataatagtttcagagcaattatctccatctagctctgtagggcagaacaactcgaactctggagcccagctggtgagaaatccttttatacatagccctctcagaatcagtccaaactgaattcaagattagtttcagcagagaatctacttagctgtggctagtggcctaggtagctgttgcctctgcaggcatctaagcagccctgagaacagctgagtgccccaggtcatacctgaaactctctgcccattaaccaaggccagcgtaagctcatgttcaacaccattgcagcagccaaggtcaatcagaagaagcagtctctttctggcgaatgagtcactgcaaatggctggagagtttctctccatagtttattacatctcctctgatctgctcccctgggggagaagttggttcattgtttaccaaaatcagttgctcccactggtgtctctgctgcctctttctgctctgatgagctgcaagcttcaggcagaagcatatttcagggaaggggcgttacaaacacagcccatagcaaatgcaacttgttctagtttgtgccttccttgctttggctcatatcaattcataaggcctttttcagagtgttctaagctcctttccacatcttcattagaaggagtttaggacaggacaaagtggcttttctgtcctactgaaatatcagttgtattattacacatataccatgttcataatagacattctaagactttcatatctggggttctaataaggtacaatcctggctgctccttctgcaagaggagcacttgaggattcacagtgttcacaagaggaacactgtgtgagtgttcacacacatatgtgccgcatctctacatgaaatgcacagaactccaatttatcattagttaatgcatttaaataacaattacaaatacgaatgaaatgcatatgaactcaagcaaatttctttgactctcccttatcagttaatcaggatccttcttaggtcttctgcaacaattagagttttttcagaaagtggtccagaaaaaaaaaaaaaagctgtgcttttaaaaaatgtgttaagatcttgggcatttagtctgttggccaattctagaatggtcatcctgtcaacctacccatatgtgagtccatccttctgatttattattgtttaaaaagaacaaagaaactgcgctcatttattctgaaggataggggaatttctgttcctcactacagtgatgccacctctcaccagagttcaataatgtgaatctcttgttaacacatatttataagttagttgtattcccttaaatatttttgcttatatgaactgtagttctcagttttctacccatctaatattacatatttcagtttgtggattacccagatgccttgttctttcttctatactggagcttttggccacttaatgttctctattgacctgaagcttagctgagaagagaaaaagatgaaatttaaatgcataatttttaagttctaaattatgaatttgtcactgtgcttttctgagatgcttgaactctaccataggtcactttgaggggtcttttcaaatagtatttttattttttccattttttaattttttgagctttttatttaacttcctgcactacgctgatgtagtattttttattttttttaacagatgtgctctcactatgttggccacagtggtctcaaactcctggcctcaagcaatcctcccatctcggcctcccaaagtgctgggattacaggtgtgagccaccacacccagcctcaaatagtatttttaaatattaacatcatttctctaaggtgccctgtgtagaaaatattttccttgagtgtttgtttacagactaactgttcaaatgggaacctaataagggcaaaacaaatgatgataattagtatgtcccttcaattatttgtgggtcagaaaaatccatagcaagatagacaatatgaaacagctgaaataacaggggctttgggtcaaacagaaccaggtttgagacccttatagttatgaactgtgtgaccctggacaaagtacttaacctcagcaagcctgtaaaatgagaacaaatataacatctaacatttgttcattactttttatgtactgggcactatgctaattatgtcacatgcattcattatctcattttgtcctcaaaataatcccgtgaggaaagtactattaatatcctcattttacagatgaagaaattgaagctcagaaaggttgagtaacttgtccaaagtcacagagtagcagagcctgtaactcaatgtcatgtctgtctggctctagagaccaagtacataaacaccactagtagtactcccaatagtagtactccccttatagggtgaattgcaaggattaaatgagataatgcatgtaaggcacatgcctagcacatagcgctgttattcttactaaacattattatatattactagctaaaatttgtatagcactttactgcttgtaaagctcatttacatagtaactcattggaaactgtctcagaaaagttaaaagacttggtcaaggtcatttagcttgtaagcacactaatatcagaacctggatcttttaattccaaaacgagccattttaccttggcttttaatcactggggagtgctatgtttttctatagttattattagtaagaggtagctattttcagattaggtgagttctaatcttgccagcctctaaattgctcctttatctggtaaatcttgaaatctgtttcttgattttctgctcgattctctcctttatgtcagataattcacctttccagaaatgtggagaagtctcatttgtcccactcctacattcttttccacagttaaatatatacatgtaggtagatgtcaaattatgaatgggctatagtttgtaaggttattttgtaagttggttgtttagaaatctgagcatttctcccatgttttgaatgaacattaagtcccatagggaacccataggaacctattatgagcctgtgccagatgcaggaaaagggagagggaatgtggagaattatgaagctccttcaattcattctgggctgggctagataaaagttttgaaagtctttgcttttcacatcttctcacctcctacagcttgtcttgtttcctagtgtcccttctctttctactgccctgtacagcccccaaatcaggcctgctgtacaccaaggagtcttctaagttacaaaactatctacctgctcctactatttttttcctcttctccctctactctaaatggctgtttgatatgatataggaatttgtagaaaagtaggctaatgaaataattcatgctaaagtaggaaaggctgacttcccttatcccttctagaggtgtttacatttttaaaaaattattaataatgcaagtgaatttgtaattggtgagagctgtagcagtgaaacaaaataaagtgaaaaatggatattatgtagaaggcattttggaagaggtgtgttgcaatctgggtagaacagcccagatagggtctaattcttgttccattccttaaaccccctccagcgcatttacacacatacatgccaaacacacctcatcagttaccttggcttctagtctttttcttttcttttttttttttttttttttggagacagagtcttgctctgtcacccaggctggagtgcaatggtgtgatctcagctcactgcaagctctgcctcccgggttcacaccgttctcctgcctcagcctccccagcagctgggactacaggcgcccgccgccatgcccggctaatttttttgtatttttagtagagacggggtttcaccgtgttagccaagatggtctccgtctcctgacctcgtgatccgcccaccttggcctcccaaagtgctggaattacaggcgtgagccaccgcgcccagtctggcttctagtcttttcctcatcaaccagataactattagcatgatagcatttcagaactggaaagggttttagagctaatgtcattagcttattttataattgaggaaatagggttcagatagcaaggctcgtgctcacagttcttctgcctaagaatctaggacattttcatctatactccatgcttagctttcataagtcttgtaaaataaacttagaaatgctcatgcattgaccttgttcacttatccacttggaatttcttttttctctttggagttggcaggtggaagccatcagtgctggaggcaagatagtctgacctggtgttcttaccaacatgttctggcctggaggcctggcattctctgtcctctgccaagtggaggaattggaaaattaaaggttgtttgggggcctgggcacatgctttctttttctttaactacttataggagatatcatgagatttaaaaatgcatgtgaaagtgttaggatcatgattgcctctttcttctttctctcattgagcatttgtattttcactctaacaattggaacaagtctttttgctgccttagcagtacagcatagtggtggggatcctggtctctagaaaggcagaccacctggggccatatctcagccactacttcctggctggattaccttaacacgctccttcacttctgtgcctcagctccttcatctagaaaatagacacactgatagtttacactgtatggggttgtttaatatatggaaattcttaataaatgttagttgctgtcatcaccattatcatcaatatctatgggcctttttagtttgcttttttatttaaaaaatttttttatacttaagaaagggaagcttttctggtcttagctgcctttctctattgcctagcaatctgaaaatagtgcagtcattgaaggttaagtcgaccctttatgcaattcttgcctgggaggcctcattgtgtatagtgagtcaccaccacttagaagtggacagtgagtcagtagcctattaaggggaggtcagaagttcccctggctcaaaatgaaaggatccaaacccaaccctggggtacagaaaaaacagtgtacttatatggctgactggacttgaagtgccatggagtacctggactactccagtgagaaggcataatatggcgggtaaacgctggggctttagaatcacacaggcctcagttggatttcagctctacctctgccttgctgtgtgacctcagacaagttgcttaacctctctgtgcctcgtttttctatcatctgtaaatggaaatgatcataacaaaaattacttcatgatacaaatgagtgggaaaatgctaagaatcaagtaaatacttaaaaaaaggttattattattattattatattaccacatcatcatcattaatgggagtcgggacagacagttcagggatcagggataatggaggagcaaattaagggggaaaataacaggaacaagtctgtgtctttgatgtggtgagttttaggtagtgacacctcatttagctggtgttaagtatgaaagaagtcataatttattctttactgcatacctatgaaggaatgagtgatgtgtgttctcataatttccattttgtaaaggaagattctgaggaatagagtctaaacaatcttcatgaaaaagtacagaactgattcagcagcagttaggagctaagcttccattcagatcctgttgtatagggataactcttctggcctaggcagaggagaccttgttaggtctgtgagtccacagtatctaaaaatatgaatgtcatataatcatcctgtcattcttcttcctgatctcaattggccctcctgatttcatgccatctgcaaatttgcacatcctttgtgctcctttttgctcacattttatgccttcttttaccatctcatttactctgcatgtttcaatctttctgggcttccatttttcttctttttttaatgcagtgttgtttctctctctctctctctctctctctctctctctctctctccactcctttacagcccccacctcctccctccacaccaatcaaattcctgcttgtttcttgccatattcattatcctacctcattcccctcttattcctagaaaacagcacactcaccctcccctcctccaactctcaggcccaccctccataaattccagcagcctggcaatcagtaactttagcatcacacttcacagctctcctagtttacactacttgttactactctccttgctactgctctctagggtttctgctaaaataaaaaataaaaaaaaataaaaaaagcttcactttaaaaatatcttgggtacaagttgaacctacagttaagtttactcacacatttacacatttcatgattttattttaactagtagctcaagtccatgctcaattatgcagtgaaagaaggctagatccttaggaaacaaatttttctctattgtaaagaagaaaaatcacctaaccactcaacagaaaccccagtcctggggccactcaccctcttatctccctactcccccaatctccagctaatgggactttgctttttcctttgtcgggtcatttatttcacttttcctggcgctgagatggcctgagtctgtgtatgtgtgcacacgtgtgtggccactgcttttcttccaaaggactcacctctcttctgccattttactaggacacaggaggcggctctctgctctcgctctccctctctttttctccctgcccccaactcagcctgggctttttcctgtctcttaactccaccagtgcagcagcaactagctgagctgcttgagagagagagagagagagacagagagagagagagagagagagagagagagagtgtgtgtgtgtgtgtgtgtgtgtgtgtgtgtgtgtgtgtgtgcctgcgtgcgcagctaggccaagcctgcgagcctgcctgtcactggagagttttagtttgcattcagaagaaaggaggaggggagacaagaggggaggaggaaaaggtggaggggggaggagtgggggggcgcagagaagggagggagaatgtcttgtttgtggcttgtcagcaattgcttgagacaagcttccatgtgtgaaagctacttggcatgaatgcctgggccgtaccaagtgtcaccgcagcaagagggggagtcagaagaaaaacagatcagaccagagcagacaataggcccctaaagtgttccccctaagttgctttgatgttgtcctggtgtcttgataccaggaggccagggattgcaggaaaagggtcttttttgtcttcattcactttcccccctcagtttctgaaatgattctccagaatttctcctcataaaaaaggtaagagccctaacaattccttcttcggtggcaggcttgttcgcctgtgcctggaagtgggggtctcattcctgcgctgctctggaggagcgctggggtcctgcgattggagctcctgcgttgcccctggaagtctttcaaggcatccaggactggggatggcccctctttcgagggaaccccagtaacacgatctgtgcctctgggttggtgggggagaaggggtggatggagagggctgggaggagggtgtgagggtgggagggaaaagagagagagagagggagcgcgagagagggaagcctggaaaagagggagagaagggcagagccttggttcagggaaaccccagcccagagcccagggaggccttgcaggctccgagctgtgcattctcaggctgagcaagggccggccagggctccgccgagtgactgcagagattgcatcgagctttgtgtgtgccagtgtgcccgtgggtctgtgtgtgcgtgtggacttcccacacactgccctggcgtgcctcgctgtgaaggggaggcaccccgatccttaccaccccagcccagactctccgaggaggagcggcatggcaggcaagaagggagagcaagagaactctgccacaagacgatccagaaacttttccagtctcagggattcctctggtcgtagagactgttgagttgtggggtgccccgtgcctcaatttccccatctgtaaaatcaaggttgctgatcagggatgctgtatgcctccctgggattgagcgaaacagaacagatcactgtgtctgaaacgcgtggagaaatcgtcagctagagatgctgtggaatcacagagtagaagtgttatcattattcttgatcatcatcatcagggtaataaaaacatcattaaagacaccctgagacaaatagactgaggagcacagatcaagtgtctgagcatttctaaggaaacaaaaagccttgttccacctgttggcttctgtcctttttctcttgtgtcttttcgttagatttattggccgatttgtacagagaatggggtgggaggggttgggttttcccctttcctcctccttgtacgtatttttgttttaaagaaggtcaatgtaagatgcttgagcgagaaaatgtgcctcctggtatagtagtttattcaagaccttgtgttttctggggctggcagggcatgcagacgcatctgtaaactctaccttggaggttaaagatttttattgtggcttttagagattaaatgagatttatttacaattgctgtttatcagagagtaaatatcttactgtgtgtgtacgaggctaagaatgtgaaggctgtttactcgccggtggttttgtggataaaaccttttgctttttcaagtgacatcttgagggatggaacagagggctaaaatcagtgcctaacattcatcttaacaattttttttgaggaaaaaaaatgtctgcttattttcttgaattgtggatttcctttcttctgttcctacacattgattgtttaaaggctctcagttgtagctctctctgaattctctggaggagttctgctttcttacctaattctaggttttctgtgactctgctacttgtccaaaaaaatctgtaaaagtctaggaggctgtgcctccttccattctaactgcaaatgtttatcagactgactccctgtgatagctggagattgaagcaaagggccagccctggttgagaatatttatgtgcttttcacagaggcctggaaacctgacttctgagtatgggaaaagctgaaggaaagccattagttggcctggatctggcaagaaggtccccctacatttaaggttttattaaaataaagctgtattttatgcatatatatatctgaaaacttagttgttttctactttatagtcagagatcttaccatggttgttcctgacaagatttcagggtccagatatcttcctaaaatgttagaatttaagaactgcaaggaaaaagaagtgttattccatcatgttatagatgaggatgttaaggtccaagagagataagcactgatctgaggcgggtgcaacaaagctgtggtaacatctagaccacaccctggggttcagagtaccccaagggtcttcatgccgggtacccttacctcacacccacatttgattttacaaactccagcacttggccaaccaaagagaggcaccttttgtagttctgcttgctgtgctggattacagcagcacactctgccctgctcatgtcatcaaatggtacaaatatgcaaacatgggtccacaacatgaatttgcataaattcattcatgtattcatttgttcattcaacttatattttggggctctttactctgcagcaggcaaatactgggcactgaggatataggaagagaaaggcagatatacccctgccctcagggaacttacagtcttgttggtatgatcaacattaaccacatggtcacacaaaccagtaatcataatattgatgatacttgttgaatagcatgcaagtattatgacggagtgcatagagttgcataagttattgactcaaagtgtgtaactagacataagctaactgttctctttctctgtgtggctgagttccccttgccccagccgacctccattccactggtgccattcctattcacagggagcccagcaattccaaagagcagaaaattctccttccctctctcaccatccttcactctctctctttttcttagcacacagaccaacaaataatatctgctaatcccctacacttgtgccatgaagtaacttcactcttgtagtgagcagcctaacattgttacctggataattcatgttgaccgtggttagtgagactctgatctcgttttactgattccatcgttcttccagggctggtactaaacactcagctgcaagagactccaccattatcactgtcatcttggaattccaaagacaatataataaaatgacctttcctacccctcccagcaaggacacatatcctacccctcccagtgaggactcataaagggaaaaaaaaattaaatacctttttagcagatctctggttgtgctattaaaatctgactggtttagtgatatcaaagatagaatgttttttctctctctctctctcttcctcctatttgtggcctttcttggaaagaatatagtgtctggttgaaatgccagtcatttccacggaggcagatttgtgttaatgttggcatcaccattttctacatcgtgtctttctctagtactcagtggagtgttgtcttcagtgttgtcaatccatctttttttttaagattaatttaatagtttttttagaagacagacatgcccacccacacataaatcataggttcgatgcctatactttgggaacccacacataatgtgtggttaagtcgtgtcatgagaaaaataagagtcatttctacatacccagcattgttacacagggatgtgcccagcccacattgtagcaacaacctaaaccggagcttgccagcttgctgtggtctgcatttggcacctgtggccaacgcctcctcctctgagcggtatgcacttcatttgcaagtctttgatcacttccgacatactctcccccaccccaagtgtgttactcaccggggagctgcctcttggggaggcagtctgagttggcattggaagagtaatctaagaagaggagtaatccaagtggggagttgaggagtgagtaaaacgaggatctggtcagaggaaagatttaacagaactggagagccagacagcagtgataacaggtcatctttaactctgggggaagaaaactgaagactgttatgacattttaaaggtgcaatgtgtaggtactctgcataaataaaaattctagagtctctagtcctgctgaaagtaaaaccaacacaacatgcaggacattcccaaaactcactagttacaaatacggcttttgcatatagctttactgaaggggattttgtagtttttctactcccaagagacataaatataagatgtacaatggaaattttctccattccttttaaaccttgacattttaatgcactttaaaatatctgcttagtcctctattataacagctctgtgaattaaacagtattgttatccttctgttatatttgagtaaggttatgtgactcacccaaggactcacaagaaaatgaggggtgaaactgctagctaattaaatctccttgttaggccatctctgcaagagatgagaagcagagaacagaggcaatcaccacaacattcagattaaaggtaacgtgttgacttggcattaaaataattgccttgggccaggcacggtggcttaatcctgtaatcccagcactttgggaggccgaggcgggcggatcacgaggtcaggagatcgagaccatcctggctaaaacggtgaaaccccgtctctactaaaaatacaaaaaaaattagccgggcttggtggcgggcgcctgtagtcccagctactccggaggctgaggcaggagaatggtgtgaacccaggaggaggagcttgcagtaagctgagatcccgccactgtactccagcctgggtgacagagtaagactccaaaaaaaaaaaataataaataataatagttgcctaagttttgccatcccccccctttttttaaaacactagaatttagagtgttcatcgaaaaaagggatcctagttctagtttaataatgacatgttatctacaaagtgcaatggaccagcttctagctttggttttgccagtctgtggcctagaaatccccattctacttctctagacctctcagaatgagggaattggactaaatcatctttaagcttccttccagctctgctattcagtatttttctgattctgtgaataggatacttcatgaatctggtctttggtcaccttatatgaagcccaattcaagaactatagttatcaaaggggaaagggtagtgggttttgtggatatataggattcattcctatacgtctatatctatcatagcgactatgttgacattttgaagtgaaaagctcaatgggaaaaagtgagattttaatttatatcctttaggagaaattgccagtcagcatgcagacacatgtgcaagagaccaaagaaccatttctgaaagaataggctgttttgaatgcatgtttttctgtataagtatgaatttaaaatggacgggcactgggtacatctcttagctttgctgttctcacaggcttttccataaaaatcgtgttttttttttatattgtgctcacatgttgttttgaggatgcaaagaaacagtgtaagcaactatagtgctgatgatacatgctatgcgtttaacactatgcttttggggatgacaggacaatctttatgacatgcaactcctgaaagagattattgaagacttgctgatatgttacgtatgtgtatgtgtgtataaaatatgtgtgtgcatatatattatatatgcctttaagatatgagtaataagctgcttctgaaatgtgattgagggtgagacagagggtagagaatgaatgatgttttcattaatcatgtcatctctatgagtaattccaagcactattcatttgaaattggttaaacctttgaaaagatataatttaaaaattttacacaatggctcttaatgcaatttttagaactccagagtaaattttctgccatgttttaggaatatcatcttgcttggagcaagggaaaccagttcaaggttgctttgacagtaaaccactgactctattttaattagttttacgttttctcatctggaaaaaaatagtatgtaagatataattactttctagctgggaaagaggatttttcacactgtatgtaataattttttgacttacaatgttcctttattctgggttgcttaaaattcctgacattgaatatcttgcttaatgtcataacaataataataagtagatgcataagagaaatttattgttaactttaaagacgggaaaaaagaaatagtttagtgaagtggacatgccagtaagacttttagaacctaagaatgtactctgtagaaatttgtgaagcgtttggttaccgatgaatgctaaacattataaaggaaaagaaaagcatattctacatattattgttgccaatctaatttttaatgatctaagtagttatcaaaagtattcttaaagattcaaaatgccttcagtttaaaactttggagagctttagtaattccatgaaaatcacaatcactctttttcctgaaaaatacgcaaattcaaaactaccactaatggcatttgaaggaaaccaagctgtcatttgctcagaagagaaacttatgaaccttggagtagctttttatctgggataatactagatatgttggactttctgttatccttagggcttgtgtagttagtatatgtttgaggagagaaattttgctgggggtctgtggacaagggtcattttgagtgaaggttaaggtcatacttgctctaaggatgcttggattggtggtttactgtatagacatccatgacacactggagtgtttaaggcaaccatagtctaaagaattcaggactttaactcctgtgccagtgcccacgttgctgtctctgcctggagtgtctttttgccttatcttttccaagccagctccagctgctcctttcaagatttatcctgggcatttcttctgggaagtttcctggacccaaaccatgtcattcctgctctaccacctcctagactgggtatgcacttatgtggctcttatcatactgcactagaatcatctgcctcctgctctgggctgtggcccctcaaagattgggattgtttgtagtttttgtacccctaatccttagcatagggtgaaacagaacaggcaatcaataaatgttggtgaatgaataaacagttcacattgaaatagagctaattaataaatttaattaaatatacatccagaggctgaggtgggagaattgcttgagaccagcctgggtgagatagtgagaccctgtctcaaaaaaaaagtataaatacaaaaagaattgacaagaagaatcttaaattgcaaccttatgttgcattaaagaaaggaaatttctcatagggtatccgttttctctcctgttgcaaagaataaaatatacagtcataataaagcatttcgtatactctcaaattctctccttttctttctttctttttttttttttttttttgactgagttttgctctgttgcctaggctggagtgccgtggtgagatctcggctcactgcaacctctgtctcctgggttcaagcgattctcctgcctcagccttccaagtagctgggattacaggtgtgcaccatgacacccagctaatttttgtatatttagtagagacagagttttgccgtgttggccaggctggtcttgaactcctgacctcaagcgatccacccacctcaacctcccaaagtgctgggattacaggcatgagccactgcactcggcctcctctactttcttatgcccagctttttccccctaaagcttttgtttttcatgtttcccactcttggaccttgtgatttcctacaactttattttttacgtcaaagaatcacagatgataaatgagttagttaagtttgcctatcttacctgctatttattaatatttaggtagtagctaaagaagagaagtttcttctagctcagaaacaggaaaaatcagagatctttgaggaagtctggacaatcagagaatagaaggtgaatgcctgacttccaggaatctgcagttgtgaccatctgaaacaaagaaggagtcactgtaatttaactttcattttctaaaaaaggttttaagtgctaaaccctctagaaaagggcttctggttgcaaaggactgactcactcaggtttcctctagaaaagtgacattcatcgtgaagatgctcacagatagagcctgcaatcaagactcggaaaccttttaggtgctgaggcagctctggggacaaccttctctttcatatcagtctgattctctccctctgtgtttgctttcctcaggctcttttgctactcactgctttgatcttctagcttttttctgagtaaccactctcaatctcataggtttttaattacacccctaattgttgcttctttgacttgtcaagagccccatgtccagaatctactctctctactcttcccacttcatggcttttcctcatggtttctttccttacattctttcagctgcaattttccctgataattgcttccttctctcagaattccctaatttagattcccaagaaaggatccagttaacccaactcatctttttcactgccatgctttataggttcttagccagcttaaggttggagctgtccgtgagccagaaggtcacctctagtctaggatgttgtggtaaagggagatgggtaggggtagagcggttgtcacttggtataaaactggactgtcttttagtacgaaccatggaagggccatcttcccttccacgtaactggcaatgaatatatttgacacagctaatataagcccattatggaagtctaggaaattaaggctaactagattactaaaaattaaaattttcatgggtgacaattagtataactgagataaaaagaccatgagaacaatggcaaatttataacaaaaaaaattgggagagggaagtgtattagagttagctcttagatgagtgacgtcatttcatgtatttatcaaaaagcaagaataggtgaatagtgagagtgagaatatattgacatggatcccacaggctagtttaaaaagcaagcatactactggaattggggaccaggatgaggataaatagaagcattaaactccatagggagcttcaaagcctgtgctttcttcctgtgctttcttcctatgcttccctgttctgtacttgatccaacttatttgtaacttctggaacagtctgtcctgaactggttatgtgaccttgggctggttatttattctctcggaaactcagttcatcatctgtaaaatagggataataattgttatttaaatagcttgtcttaagaattaaattagatgggatcatatatttaaagtgactgatacacattacctgatatgtaaaaggcactcaatcagctgtagcaattattctagaacataaggaggaaggaaatgttgacagaacaatgtgctgggtaaaattccactttttgtatcatttattccttataacaatcctgagggacttgtattattatttctactttataaatgaggagacaataataataattgagtatttgctatgtgccacacactgagctaaactcttccaggcattgtctcattcaaactgcgataggtgctattaataccttcatctcatagttgaggacactgcggtctagagagtataacttgcccaacatcatccaattagtaagtgacaactagagtgtaagtctatctaaagctgggtcagtctgaccgcaaaggatttccaaagtcatataattgctaagtgactgagtcaaggctcaggtcttgttaagggcagtacttcttcagtgcacagccaaaggtacatgctgattgaatgaaggatagtggcaggcacacacctattagggtctctgactctgagtgccatggttagtcaaggataagttttggatagggtactgttatggttcagctgttccctccataacttatgttcaaatttaattgccattatgacagtattaacaggtaagacctttaagaggcggagaggtcataagggcttcatcctcatgaatggattagcactgttatcttgggagtgggttagttatcaagggagtgggctcccgataaaaggatgaatttggcccccattttccctctgccatgcccacatgttcactcaccatgtgatgccttctgctatggagtgaccctcacaagatgtggccccttaatcttggactttccagactctagcaaataaatttcttttctttataaatgacgcagtctgtggtatcctgttacagcagcagaaaatggactaaggtatagacttttaaaagttttaataatttaaatatgtcaaaataaggtctctgagacctgaggaagtgatttaacaaatatgataaatatctgttgtatgtcaggcaatgaaaattagcttggcattgtggggtgcaagatgactgaggcttgaatccctacctttaaggtgctttcatcctggtggagagagacagatattcacagaactaattataaagcatataccaatggatcaaaagaactgtggtagtcacgggagagaacaattaatttggtggtgaagggaataatggtggaaggaattggggaacacttcatgaaggagatgacatttgcaatggtccttgagggatgaatgtggaagtactagacgtcttctatagtttagtttttcttcacaccagtggttttataaagggtgatataaagtagcattgtaatgactgaataatagattgaggccaggtgcagtggctcacacctgtaatcttagcactttgggaggccaaggcgggtggaacaactgaggtcaggagttcgagaccaccctgaccaacatggaaaccctgtctctactaaaaaatacaaaattagccaggcgtggtggcgcatgcctgtaatcccagctactcgggagactgaggcaggagaatcacttgaacccaggaggcagaggttgcagtgagctgagatcgcaccattgcactccagcctgggcaaaaagagtgaaactctgtctcaaaaaataaaacaaacaaacaaacgaaaagattaacagataataatgcttttaaagattagtttccttgagtgaaagcagagaaatatccactcttactaaccataagactatattggcattttcctagtctgtacttacccagagttctgttgaaggaatcacacaatgaaataccctgttctacgctttctaggtttgggttctagagttgaacagcaatctaacaagggcctataaatccctggtgtgaccatatgggacactagtgtgagttcttgtgcagtacaaaggagtactaaggtactgacagatgggtcatttattcatctactctttgagattttagtctgcagttgggaatttccaattttttttttttttacatacaataccaggctttctggatttggtggtttttttggagacagtcctaatttaaaacattctgccttgtctccataagtatattcatgattagtagtcagtatattctggtggttgtttcaggttgttcagttacattgagtttctacatccgaatcctgtttaaagagggcctagtagacatcttctgcattatggactttgttcacttgctgtgacaaagtgcatactgactggtctttacactgtaaggtagaacctcagctaagctctcttattctgttttggtttggttctttacttagcttctcttttcccaaactctgcagatggacattagactcattcttatttcaaggactggctcaaatgtcacattctgcacggtctttttcaattcctagagccagaggactcttgcatccatgctatattctactttgcttagaatgatcatattagctatatgtgttcactatcacaaatcccttaatagagagtaaaccagagggtaaggatttaggtcctgttcacctctgcatctccaagagtatccagcagagttcctctccttacaagtggttgtgctcagagatgtttattgaactcaactgaattgaattcttggcttcattggatttgctttgagtatggtaacattgatgtctgtgccctagttcccttttggaaaagaaatgctgccttaaaaataaaaagcatcttaagtgattttgggatgaaagacaccatgtaatataagcagtaattgtaattattattaataagcatcattaaaatagtatgaactgataggattacttcctttgcttgcttttgccagcagagttggcaggtttgataaactaactggtcttttccatcttcaatatctatgattctttgaaattttatgtagacaagtgcaaactaatgtacactggaaggaacaattgaaacagctcatactcactgatgggctctgaattactctacttgtaagtgctcaggaaaaagatcttggattcattgtggattgctcaatggagacatctgctcactgtgcaccagcagtcagaagaatgaatgagatataataggctgtattaactttgagaatgggataaagaataatgcagaaaataatatagtgtgcataatttgccattgactatttctgtaattacaataaaacattttaatgatatacactgatgttacgattcaccttaaaatcagaaatcagcattgggtcctttcatttcaaagaaaacaaagcagaaatacaaaggttccagggaagaacaacagacagtctcaaagacatacagggatttatctgtaatgagaaactgaaaagagaaggacattttaattttgggtaaagggaaagatgacattgtataaatttatttaaaattaatgaaaatttcagaaaattgctggagctggcttctgtttatccttagtaatggaggtcagagataggcaggataattggaatccttgataatctccaatcctcattttagctattagttgcagcatcctgtcctaccagtagttctaacaaatgaaaaaatataataccagacatgacagctcagggtttgtgaagtgaacagctcatgagaaaggcagtctgggctattgagaagtccacagaatttggaatcaggcgacctgggttctagtccttgctccctgtttattgtctgcgcaaccttgaatgaagtgtttaacttctatgagacctagtttctacatgggtaaaatggagatagtggaaatagttattttacaggatctttgggggaactgagtgagctagttggaagtgatggctggactgtgctggttgagtattggttgttgagagtgcttgcctcaggggccaacatatctccaggtccctggtgcttacacaccacctttctttctcttcaatctcctacttcttaatgatcttggcaagagattttagaagtataaaacattttcttcatctcagaatcagcattcctactcccttgctcctgaaaagccttaaaataattttgcactcatttttattaatgtatgattaattagaggtcatcttatgtaatcttcacagcagccccttgaggtgggtactgctattatcctcatctttcagatgcagaccccgagacatagaagacttgtttaagaacacacagtaatggcagactaaagagtcaaacttatgctatcatgcctctgggttggtttacgaagtctagaacactgagttatgtgactatactgatttctcccctgggaagtgactggctttccttatttccctaggaactcctactctatactttggcacccaactcaggactcacctgcccccatggaggctgtcctaagccctctcttcccctgtaagagatcatcttgtttgccttcacaccctgtattgtagcttttaacgtattatttggttaacaacagtagagacccttatacccaattcaattaataactaacgatttagttgaacaagttagttaaggcaggaatcataccaaatgatggaaacataccttaagcttttattttaatttaaaacatgcctcaggtttttgatgttgggccaaggccccatctttggagtcgaaggcttcctattagacttctgagtctcgtttcttacataagtcacacccctgaagctttcccaatcattttttgtcccgggttctttaaagtggagcaagatcttaaagacatttgtggggcaatcagattttccagatttaatgatgttttgtggttggctctctcatgcctaagttgatagcacattttttagtaactcatttttaaagccttttctaaacattcaccttagatcttacagaaacaacatctcttttgcactcatatttcattactttaagtaagcttaattaaattatgtaattacaataataggaagaagtagcacaaataggcttgggaacaaacactgattcttggtgagcagacagctccactggtggcaggaagggcatgaaggtgtcctagagtagcctactactagcagtgaggctcagcagattgagggtcttacatctttacaattatttatttatttacttatttacttatttattttgagacagagtctcacagtgttgtctgggctggagtgcaatggctccatcttggctcaccacaatctctgcctccagggttcaagcaattctcctgcctcggcctcctgagtagctgggattacaggagcccgccaccactcctgactatttttttttttttgtatcttttagtagagactggatttcactatgttggctaggctggtctcgagctcctgacctcatgatctgcctgcctcggcctcccaaagtgctgggattacaggcgtgagccaccgcgcccagcctcatttatttatttatttattatttttatttttatttttattttttgagacagagtctccctctgtcgcccaggctggaatgcagtggcacaatcacagtcactgcaactttgacctctcaggcttaaacagttctcccacctcagcctgagtagctgaaactacaggagtgcatcaccacacttagctaatttttaaatgtttttgtagagacagggtctcattatgttgctcaggctggtcttgaactcttaggctcaagtgatcctcccaccttggcccccaaagtgctgggattacaggtgtgagccactgcacctggccatctttacatttaaggagtgaatggagaccacagattagtcacttaagtgttggtcacttgagacagctcctgctcaatatgacatctgtttcatgtctttgccatagatgaatgccttgaaggtctagattgtatctctccagttagtctcagaacctagagcagtgatgggtatacagtgggccctcagtgaccattgactgactagctaactgaccataccaacaaaaacaaagcttggctttgccactgcacatcctcaggcagggtaccaagcagcaatctactgtctagaagttgagcaagggggagagagacagagacagatctagcaaatgaatttctaatattgctgcaagataagatgatatataccattaaatagttttaaaatgtaaggcagctataaagaagatgactttgtagtaatatgtaattaacctgggtaactcactagcacaaaataacagtgacacaacttgcttgataacattttataatggactagatacattcttatgtgaggaaaaaaatcctcatttacaaccataatatctgagcacaaaaagtctttctggtgattatgttcaaggccagccagatcaagaaaaaatttcccttacagatatatccttgcagctttgagtttattatatgcttcttgtgacaaagtaaagcatcttgtattgagcaccagtagaggaaagaagtcagatctggaggatattcagcttgacaagacatctgtggtaagtgactggtttggaagataagggtagaggcttggtgatcgcagggatatcctccttcctaagataaagcaggcaaacacatttagccttgtgctcaataaatgaatttcacgttgaactaaaatatactgagcaagcagagttggaaagttgtagaatatttaccctaccataggaaatgggatgagaaaaaatatatatacatgtatattttatatatgcatgtctataaaagaaataatcttccataggatcccatgggtgcaaactttctcattaattttccacattggaaatctgtaggcttcttccaattattaattatttagaacctccctgttcctcaagaggttgtgaagcagttgtctaaaacaggaaggatgaaattaacattgtactgagtactcactgtgtgtcagccattatgctaattatttaatatatgtcaccatattcctttgaatgtaagttgccattgatttttgtaagacccacattactttacatgccactatgaaagaaaaaaaacatacccagtcaaactgtatgtataccatacacactatcaatgttaaaaaatgtgcatcttagaatcagtgagatgtggtatgtcatttaattctcccaacaacccttaaactaagtaataatatgggtagatgaaaaaagtgaggcttggagaagtcaagtaatttgcctaaagtcaaatagcatgtaagtgtcagagctgcggtttgacccagattaatctgtctcaaaatccagtatgctgtccttagtaccatgctgctgattgaaatcagcacttgcccagaactcagagctaaataaataaataaatgcatggtatccccctaaaagcacttatctttggacttctctcccaaagacctttcctcagagaaaactctggatgactctggagtcaatggctgctatggatttctaagagtagaaggaaatcttgcgttccttggtctggtctcctctggtgtctgataatgcctgctgcccccaccaaccccaaggaaccacacacgctctgtggaagcacaagtgggctttgcttttatcttcttgttggtcctggttctatctgtggagacatggagagtgagccttacgcatcttaccatgacatggcccttcctgtatttgaaaacaggtgtgagcgtcccccgaagacttcttttcttccagcagaacattctgagttccttataggacatgatatagaaatctctctttctctccagctactatactgaatgcacttcagtttgtctgtggtccttttaaacagaagcattcaaaattgattgcgtggctccacaaggagtaggtgaactatcacctcccttgctttagtccacacttctctgggtgcagcctgagagtgcatttgatttttccagcacctcatcacataagtataaactcctcctccccctacttcatctcctttactctagccttttctcctcctccttttaaacacatgcttctatgtaggcaacttggacttttgtaatttttatgtggggctgaaattatttctgcttttatcacttttgaaatttgtcttgttagaattgatattttgaaggttttttctttctttcttcttctttttttttttttggcatttgatggtcatctctcctactttttttttcttctttaccaggaaagtcagtgatcttctaattttgtaacatcctcaaatgagatttttaaaagtattttctatagttttagccaaatcattgctatctaaattgagtaggacaggctcaaagacagagctctttgggaggtcataagaaatcttttcattgttctgttaccaatccatcagattcctctgtcatcagcttgtatttctctctcttgtctataaacatagcagttgctttatatgtgccattccatttaaactgcaaaatttcacataccaagtacttttgttcctgtttaggttaggcaagccaaactatagataggtgaagcattttgcacagaatttccctgtttgttaaaagaagaaccaggatttgcacccaaactttcatgtcccttctactctgtcgtggttgtacccattgtggattaccttgatgaaatgcagagatggtatttttacctcattttcctggactgcaagagagtgcttttgaccccaaggagccaaatgttataatagaaatgtactctcttccttcctccttcagagaaccacaagcaagagagtaaatacctcgttcctctctaaggacggtactcacacccttactttccccactgacttcttttagaaacagatagaaaaatagtatttgaaaaagaagattcttttctgggctgtctgagcaatggaacagttgttgggtcctgaaggccaggaactaagacccagagaaaacagagactttcagaagcttagtaaaaccctggttacataaactcttggaaaccagagtttgaaagccttgctttcactctcttcctctaggatatgctaagagaacttcatatttcagagtaagtacagactgttgtaaagttaaaagaacagaacagaaaaagaatgtaaatgatgcagggaaacacttgtgctattcagaccacaactgctatcaagcttgttggtaggcaaggtgtgtgggatagacgaaattcatgagaagcagtagcccaaggtgagtgtcaaatgccatgcttctctctcacactgagggactgatctttggtggattccttaatctttcaggaggggagtctttttaactattaaaaaggaataaggccaggccgggcgcggtggctcacacctgtaatcccagcactttgggaggatgaggcgggtggatcacctgaggtcaggagttctagaccagcctggccaacatggtgaaaccccctctctactaaaaatacaaaaattagctgggcttggtggctggtgcctgtaatcccagctactcaggggcgggatgggggtagggcgccgagggtggagaatcgcttgaacccgagaggcggaggttgcagtgagccgagatcgcaccatcacactccagcctgggggacaacagcgagacttcatctaaaaaaaaaaaaagaataaggccaggagcagtggctcactcctgtaatcccagcattttgggaggctaaggggggttgtggggatgacttgagcctaggagtttaagaccagccctggcaacatagtgagacctcatctttataaaaataaatacatacataaataatttttttaaagtaataaaaacaaggcatcgttacttcatggagtttcatgattctcagacataattaataatagatggtttacaatatattaacaatatatgtaatttaaataacaacagggacacctaggtatcctcttactcataaagagagtcaaggtcagtgcctgaggcaaaagacagtgagtgaggaaaagttgcctcattgctttccaagcaaatgttacgcccattttctacataaatagaagtctttgctccatgaggaggttcattcactatctttgttccaaagcaaagtcacttaagataaatgaactcaccaatgcaattgattgaggtaaaccccaacacacactttagtctttctggaatgctaatatagtacagcaaagaattaggaaattagctgaaacttttatctttttttctcaaaagaaactgctcaactcaaaattaattgctaagggagatggttttacattatttcccataaacctaccacggggattgaaggaccatggatagcggggaggcacagacatggaatctatgtcctagggcactgttaacacagtgcataattttcagcaactcccaagtgacttgttctgacatccattccatgtaaaacaatggaaacctatttccaggcttatttgtgtttcctaggggcccttcaatgccattgtgaagattaaaggactagacccttctcattccctcttatgattattcataattttctaaaatcatcttattgcgtgatgcagcccaaacatgaattttagtgtctatttgtctatttattcatttgttcattcattcttcaacgaatatttatcaagcacttccttcacatcatgttttctgctaggaacttaataggcataaaaaatgaatacgattcagtccccatccttaaggagctaataatataataggggagtaagacatgtacacagataactgtaatacaaagaatataataaatgccttaaacaggttcagacaaaatcctgtgggaggttcacatctagtcagaaagagcagcgagagtgtcatggagatggtatcatttgactctctagggattgactagtataggagctcaacagatgttattggaggaaatgtcaattcagacccagaaaatggcataaataaagagtcatgttctgagaagaggaagtaaaccagtttggccagaacataggataaatgtaggcaaatgtggagaggatagagaagagcagttcaagatacctggtagaggccgggcgtggtggctcacgcctgtaatcccagcactttaggaggccgaggcgggcggatcacctgaggtcgggagttcaagaccagcctgaccaacatggagaaaccctgtctctactaaaaatacaacattagccaggagtggtggcgcatgcctgtaatcctagctactcgggaaggctgaggcaggagactcgcttgaactcaggaggcagagattgcggtgagctgagatctcaccattgcactccagactggacaacaagagcgaaattccatctcaaaaataaataaataaataaataaaggtacctggtagaggatcttaaacagtgggttagagaattacaatttcatttcttcggtactggggagccattaaacgttcttgagcaggagtgacatatgcacacctttatttttcagagacataatctgacagtagtgcatgggttggattgcagaaggatcagaagaccagtttgagagttactgaagtaattctagggagaaatgataaggacttgaattagaaagctggcaataaaaatgcaaaggggagttgagcttcataaacactactgaggctgacttgatgggatttgggaatagactgaatggaggcagggagagactcacatgtgactacctaactggcaaaataatgatgctcttaagagaaagtgggtgcatgcacttgcacatttatacttaggagtgtggacggggggtggcaggattagaagtaatctttttaaaaggcaaatcaaatctcattgctgtcccacttaatatcaaaatggctttcactgcatttagaataaaatccaaaccccttaccatggcgtggtggaagccctacaggatctggtccctgcttttctctgacctcatctcttaaaacgctctcctttggtttagctttagccacactggccttttttcagttcctcaagtgcactgagttcatttctgcctcagggcctttgcattcactgtaacctctgcccagaacactgtgtccccagatcttcacatggttggccccttttgtcagtcaggccttagcttaaatgtcacctcttcagagagccgttcctaaccaatcaattctcttactcttcactcacagccactctttgtcacatggtcctgctttttattcttcacagcacttactaaaatctgaaatgatcttatttatttgtttactttgtttatgtcggctcctcttcaccaaaagtaagcccctagagtgtgtcttgttcattgctgtgccctgatgattagaacagagcctaacacatagccataaatagtcattgaatggatgaataaatgagtgggttctattaagggaatgttggcttctcatgcaggtataacaacattcaggtagacatgggcaacaaggacctagatacatggggttaggactcaagagagggctagatttaacatctgctttcaggatatggaaagtcaggggaaggtatgacaatttgtgggcctttttgaacaaaggcatcacttcagtgcttctgccatagtcaccgatcctatcaatgactgttttaaaacctgtgatatccatccaacttaactttcagtgtccaagtgagtgtcctgagatcatctacttggtagactttagcagaaatgctaccacgtctgaagtcatttttggaatttctattttagaattgcctatagagtcagcagcactttaataatgtaaaatattaacaactactactcattacacacttgtaccaagcaccgtgctaagtgttgtcacacattatctcatttaatccacttcataatcctgaaaacaggtaaaatgattctccaatgttgcagttgaggaaattgagactcagaaacgttaaatcctttgaactgtgtgagatctgaggttcaggttcattctgaataactccaaagctggcttgttaactactttgcagcattctaggaggagtgggggtgaaagggtgggaatcttcacttccttcgaacgtggatgtgacttgaaaacagacagaagctatagaacagaatcgcggctgtgccactctataggcgtgtgatctcagactagtaacttcctcaacaataaaatgatgctactaatgctctctcgtaggattgttctgttgagtgcaactgtaaaacccctggcacattgtgggaaaataagtttttgctccttttcatttctcataacagacacaagtagttcttgattcggtcagggtttgattatctagttggtggattattgagcccctggcattttctcatctttcctattatcatatttagtattttataaattgttaccatttccatgttgaagtcaggcaaggtgagggactggaggttgtactgcccgtgaaaggaactggaaaaataaagtctgaagtgattggttcaaattacagctttattatgtttgaagtctgagaccttggggaaaacgtctgagtctcaatttcctcatctgtaaaatgaggaaatatttcttctcttctacatcctgagagttgttttgaggatcaaactgtagctgtgaaggacttttggagagcataaagttaattacaactgtaaggtactattatcattgcctgcattacaaaacgagggtctatccttctttttagaaggtctaaaagaataaatgtgctctatttgtgaattgcctaaattaaacctgtgccttcctttattcttctgttgaaacagttctcaaaccactcccttgttcttttatctttatacctaaagtctggcttacataaagttaatatctacccggtccaatatggtaaccactatccgtatgtggccatttaaatttaaattaataaataaaaatttaaaaattcagctctttagtcacactagcctaatttcgagtactcaatagctacatgtaactagtggctaccatattgggcagtgcagatagagaacatttccatctctgcagaacgttctagtggacaacactgttgttgattctcttgaattccatttttttaatgctttctctcccaactttagccatgataaaaccaagctagttattctttagttaataacccagtgtacttgccaatgactacatcacagactgtcaagaatctaaaggctgttagccatcctctactctaaccttttaattttatacatgagaaaatgtaagctcaaagaggcaaaatcactcgctcaagcccatgcaactcttcaatggattcccactactgattccacaatgtaactacaaatacatgagtaatagaggaggcttacattcctctcacagaagtgctaataccttccatctcagaagaaaatatgcctgagacagaacttacaatttgctagctgttatcagtgggcattcttcctcttgcctggccaagtgctgttggtgagtgctcattatgtcacagtgaagatacgatgaaaattggatagcacatctttccacttctacctctgttaaattacaagtgtcctagaaggctggctgctttgggagctagagtgttctgtgattcagaattccccagacccagctaaaatcccctgggataggccttacttcttctttacacactcacttaaattatgaaatattggatctttaagcaaacttctagagaatttggaatggagattgttgtctcccaggattgcatgcaatacagatataaaacactcttgctcatagctcttggtatgtagtaggtgcccagtagatatctgacatagctcttgggacatagtaggtgcttggtaggtgattaatttcctcccctccagatctacccactttcacccccatcctcttaccagaggccagcgcttttctagataaccaacacaatacttgcaattcccatcttcttgttgctagaaccccaaactactgtttcttacaattattttcccattgattaatcttcactgagagcccataatcaagggcacagtgtacctaacagttgtaaagttggtgggggagggggaatatttgtaacatttatcatgaagacatttagcatcaagacagaggagctggttgctggaaaagcatttctaaagacaacagggcaccacagttgaggcaggaaatatgccaaaaacttcactgtgtagtttctctatttctccaatatgcattgtagctgtagggtccattcttcaggtgaaaattgaatgttggggccctactgggaaagaggttagctgggtacctgagaataaaatgtatgtataggcaggagtgggtctaggttttgtggagcctgaagcttcctcaattcaggggacccccctgaagaaaataatattcaaaattacttagatgcagggccttggaaggagactatgaaagtcatgggccggccatggccaggcgcggtggctcacacctgtattcccagcactttggggaggccgaggcaggcggatcacgaggtccggagatcgagaccatcctggctaacacggtgaaaccctgtctctactaaaaatacaaaaaattagccgggcgtggtggcgggcgcctgtagtcccagctagacgggaggccgaggcaggagaactgcgtgaacccgggaggcggagtttgcagtgagccgaaatcgcgccactgcactccagccctgggtgacagagcgagacgctgtctcaaaaaaaaagaaaaaaaaaagaaagtcatgggccataaagctaaagtttcattggcttttgtgtaaaggatgaactgtgtttgtttatgtttaagatacatttggggtgaagagggaatgctaggtggaagctaatcacagaaagtctgaatatgtaaagttattgcatcaggcaccttttactaactaatcttgtacagaagctagaaaaaaagcattaaattgggccctgtgggaaatagagtctgggtggttgggaagcttaataggaggacaagaacctcttccaacgtgggtaaggagttcattccaatactgatattatctgtttacagttttattttacttagtgaaatgattatgtattatttgattaatttattgttttctaagaaaagcaaccccttcccaaccctccttctgctgacacacacatagtttcaacaagtggattttacaaacccattggctttggtgatgttttcttgtacgagtgaattcgtggactgtacagaattgaagaaatcaagtgaaatttttcagaagagaatttttggtttgtttaaatctccttaatggagattattgatactattgcaatagtaacatcatcagtaagtataggaagagaatgctactctggcctgctttgtacaattgtagataacttatttccaaaatattctatttgagtcgacatttccacacatacttggtatatgcctaaaggaaatttgggagggaaagacaaaatggaacccagtcatttatttttaagtcgagcaaaagcaggaataaaatatttcacttatgaaaaaggtatgctgaacaattaatggcacaaaattcaatatctttaaagcatcaaatttggcatgtaactgaccctcaatgagaataatgcctaactctgttgaaggaaaatatgtggggaaataatgagaccacaagaagtgaaagcaagtagtgttcctgcacaatgaagcttaaaaccgttcttgtcttaggagcctgccccttccccctccccctgctaggaaccaatctctccttccttctaatgtgcagatccccttatctacttccagggtggcattgctagtgacccagcaggtctgactgcctttctgctctattgctggcgatctatttcaaattttatatcccattgcagctctaacaatcacaccttgaaagtgtgttccttactgctctgcaactcccatgcacacacaaacactagcaaacctcatacagctgcatctctctgtgacaaagcatgctaactcctttcttatggaagcccttgcatatcaagctttagaaatgctaatgatctcacctacctctgtaatcaatgcctcttccttttggaaatgtccaagctaccctgttattctcaagaaagtcctagtcttcttacttctcccaataggctgtcataggattgaagcactttatggggaagcattgtggtcagatcatctcctaagaaatgcagttctatagccttgagaggctttaaaatctaacagcaaattcttcctaataaatgccctgttgactgatacaacctagaatgctccacttcattatggaattacaaagttttgagttagaaggaatcacagtgtattctaactgaaggcttaaattccttctatcattaaatttcatagttgggcactgttcaaatacaaaggttgttgaaagaaaaagcaaaaaagaaaaaaaaaaaacaagtttcttagtcatttcacttggatccaaacagaacaagaattaatattttgtgatttctgtacacctaccgagggggattttttttttctctttttcaaatgtagaaaggggttagacaaaataggagagctgattcaagaggactattaacaatctccttctcttatctgcttccctccctccctacagatctttctaaaagacatggtaagttagatagtaagatgtgaggccatctttgaaaaatgtcagctgtgtctagccccagggcattgggcgttccaaaagaaggaatacatttctttaaatgtatcattatttcggttcttagttttttctcaggagtttatgtctgtcttgtttctcctaccattctcattcattcattaattcagtcagtcattccctgagtacctaccattctgccaagtgccaggtatctctagaaatcataagataaatgttttcccttcagggagcacactgtgtagagtagtgatgaataagcagtccaatataaagtgacaaaaattattaatagaagcctggaggaagaaggatctaaccaacaggtagctggtggaagcaggtgaaggagaacactcttagaatgagttctacaggtctggaggaggcttatgggtgaacaaatggacaaaggagtcaagtagaagaagggcagcgaggaagagggaacagaatgtgcaaggtcatggagctattaaagaactaaaagcctttttaataaataagtattttcttgaaaaagattctttttggagagagtaaaaggaaatgagcaaggggccagaagaggaagggtctgtctcatgataagaaatttaaacttgcctgggtaactatacccacgcctgtaatcccggtactttgggaagccgaggagggtggatcacctgagctcaggagttcaagaccagcctgggcaacatggtgaaaccctgtctctactaaaatacaaaaaaaaaaaaaaaaagaaagaaaaaaaattagccaggtgtggtggcatgtgcccgtaatcctaactacacaggaggctgaggtgggagaattgcttgaacccgggagacagaggttgtggtgagccaagatctcaccactgcactccagcctggataacagagtgagactccgtctcacaaaaaaagaagagaaaaagaagaaaaaaagaaatcattcttacagtactttggaatagagcaagactggagacagagatattaactagcagactgtcatagtgaaacaggtgaaaggtgatcagggccgatggcagtgagaaagaggaggaagggatgtatttaaaacattttggagatagaatctgcaggataatgtaggagtgagggagtagaaagagtctaagatgaatcaggtttctggcttaggcatctgaatattaaagaggccattttctgaagggaaaaaaaaggagttaaaaaagaagaatcagtcacaggagaagattagttctatttatgttgaatataaagactctgtgggacatcttgatggtgatgtctaacggagcttgtggttggaaaaatctagctagaactctagttagtttcgtcaggcatttactgcttattttctgtgtgttaaatattgtgtttaacaggatgtctgagctggagctattggtttgagagccatctgtttgtaagcagcaattgaaactatggaaaatcacctagaaggagcatgatgaatgaaaagagaaagtcttgggatgggactctggagatccccgatatttaatgaaaaggtggaagaaatagctaaggaaaaggagaaagatggtgtcacagaagccatgtcaggaagagaacttcaggaagcattgaggagtcaatagtccaaatccacaaagaggttgggcaagatgtaggcaggaaggtgccttctagatttgacaatttgaagccatttgtgaccttggcgaaagcagtttctatgaagcagggcaggtggaagctttgcagtatcatctttggggcaaaaattttattttcaaattcttgtctatttacactctctgccttttgcttctgttcctcatcctatccctttgccccccattcccactcttcctaacacaaaattgttgactgattttcttttctttttttttttttttttttgagatggagttttgctcttgttgcataggctggtgtgcaatggcaagatctcagctcactgcaaactctgcctcccgggttcaagcgattctcctgcctcaacctcccgagtagctgggattacaggcatgcgccaccacgcctggctaattttgtattttcagtagagatggggtttctccatgttggtcaggctggtctcgaactcccgacctcaggtgatctgcctgcctcagcctcccaaagtgctgggattacaggtgtgagccactgtgcccagcccattgactgattttctttttttcttttccttttattttttttgagatggagttttgctcttgttgctatcggggtatttgcatgcatctcccatccaccaggctgtacaccctgggacccaccaggtgcccctgagaacatagtaggtcacacacgttccaaggcatgtctcatcatagagacaattcgtggtcaggaggtaatagctcattgttacagcatttgcagtgtgtgatcggttgtggcatttgttctcagaacttttcatttttgattctgactgctctgaggtgggtaggattgtttttattatccccattttacctagaaaaaaaatgagacaatctggtctcagatctgagtcttctgattccaaatccttccttccttcttgagccttctggccaaccatcactgatactcccattctgcagagaaagaccaacctgacaccacccttgggtggtgtattttagacataggcaagagtggtttcaggttttctaatctccaaaaaagtagctgcagctagagaccctgctcttcatcaaagcaaagctcctgggttgggaggagctcaatgaactgggaatttgggggagagtttaccactagcccctccccaggttatgttgaagtcccttagttcttcctcaaatggtgaaaaagcacccttttccctgtatcccactcccattttcctacagagggacctcagggtgatggaaatcagagagaggaaatggcctcacaacaaggtgtggtggtaggcagccctccagacacacttggtaagaaaagctggacctgctgagggttgcctcctgcagagataacacaggaagaggagagaatatgtgccttcccagacctctgcatacctgaagcagcatctaagtttccttggttttgccccaaactcctgtaccagaacccaggactctattcattttctctatgcatttgatccacatacgtttattgagcacctactataagccaggccctgtttgggtataagagataaaacatcatgcctgtaatcccagcactttgggaggctgaggcgggcggatcatgggatcatgaggtcaggagatcgagaccatcctggctaacacggtgaaaccccgtctgtactaaaaatacaaaaaaaaaaaattagctggacgtggtggcgggagcctgtagtcccagctactcgagaggctgaggcaggagaatggcgtgaacccaggaggcggagtttgcagtgagccaagattgcgccactgcactccagcctgggcaagtagagcgagactccgtctcaaaaaaacaaaaacaaaaacaaaaacaaaacaaaaacaaacgtaaaagagataaaacaccgtaaaacacaattctgtcctggagtttacattcttgtggggtataagactaaagtccaggcatggagcaggctttctcagaaaaggttcctaagagacaagtgaccaatgtgtttccatttcagcctctcctagcattgatagacatcacttccaggacaggctagagctctgctggatgggaaagcttttgacctgagctgaccataggtgaccagccagtatgcattctaatcaccttaacacctctttagaaggaaaggttcataggtagaagtttttgtttgtttgcttttgagacagagtcttgctctgtcacccaggctggagtgcagtggcacgatattggcttattgccacctctgcctcctggattcaagcgattctcctgcctcagcctcctgagtagctgggactacaggtgcgtatcaccaagcctggctaatttttgtatttttagtagagacggagtttcgccatgttggccaggctggtctcgaactcctggcctcaagtgacccacccacctcggcctcccagactgctgggattataggcgtgagccgctacacatggccacaggtagaagaattcaatcctcagtggtaacatttaatgagaagctggggctttgttcattcatttttgtttctccggatggaacaatccagcaaataacatctatgtgtgtttctgtatgtgtgtactcacatgtgtttgtgtacccacatatttgtggaacatcttattagccttgtcagggtgttttgtattggggtgagcatcttattctccataggatggaggacttattagacacacaataaagacttaataattgatgaatattgttaaaaacaaggttgaggccgggagcggtggctcactcctataatcccagcactttgggaggaccatgtgggtggatcatctgaggtcaggagttcaagaccagcccgactaacatggtgaaaccccatctccactaaaaatacaaaaaaattaccctggcgtggtggcacatgcctgtaatcccagctactcgggaggctgaggcaggagaatcacttgaacccaggaggcggaggttgcagtgagctgagatcatgccactgcactgcagactgggcaacaggagtgaaactctgtctcaaaaaaaaagaataaggttgaaaggctcacccttgaagatgttttctctagttccttcagttacaaaagggagtggaagcaactcggtgggacagtgattgagaggataggctccggagtgagaccggggttcaatttctgaccctgtcatttaatagaagtgagggtttgttttgttttgttttaaattatttatttatttaggtctcaatttccttatctctaaaatggggagcattgctgtaaaggttaggtcagaaaattcatgtactacatttaacacaatgcctggttcactatatgcagtgaatattgttattttccaggaaggagaagtgacttctttaagtcacacagctggttagttagagataacctgaacttaactaggtttcctaactctcagtcatgtgtttttttcccactgtcactgcattatgccacaaaagagtagcaagacagataaaatgtggagcttagttcagaggtggatattatggtgccttgaagggaaaaaaaaaatcctagtgagggctcattgagggctactatgtgccaagtactatcctgcattatatatatgttacctctttaatcctcacagaatcactatatgacattgttattatccctactctagagacagaaaactgaggcttaggcagactagtttacataaacctaggcttgtctgaccctcaaacccatcactctatcctgtgatgactgtggtaagaatattgaggtcttataaatataactgcaaggcaaaaggcactctggacaaggctgtgtgggggtcagcttttgccactgtgtccactctcagtggcagccccttcctgacaccgcagttgtcatttgtggaagaacgtagtgcaatgtgagtggacaatgtttttacagtatttgtttcaccgtataggagaatctgtgtagacaaatgaagaacctactgccatttaggaccagaattccagaggaaccaaccatctgtgcacctccatgtcaggggaaggtgttttatttccagtgtgaaatgccaaatagtccaggaatgataaaatcaccctagtttttcttatgaactcctagaagtcatctttgttggtataaatgagatcatttagcctaattagttccaagcttaattagcagtaattatcccaacatgggagtaatatccgagcaggaagtgccgagtcctcgattagatagatctctaattggtgttacaatattgtaattaaagcgtgtttgtacgcctctgccacagcacgcgatttgtttcatgtctgattaaacagagagacccagcagcctttgaaggggccaaaattttagatctgactcacataacatgttaaccctgtgacaaaaaagatatggggacctacctcagtggccaaggtgagtgtacagctctgagccaaaggcatttttccagagaggatgagcccttggtctactccacactttgactcccatgtagcaagtataggaaaacagaagtatatggttgaggggccactttgtaacttttaaacctttgagggctgactcatatataaccagagaagactgtacaaaaaagacgaataataatagctactgtttattgagcatttactatgtgctggatgctgtgctaaatgctttcaatatcaaattcattaaaacttcaaaaagccctctgaggcagctattacagtccctgttttacaaataaggacctgaagatgagggagttgcttcacccaactaagtctgtgttacccttcaggtcttgccttgagcatcactcctctagaaagctacttctgatccctagaccatgttggtttcctgacacagctccttgtaattttccttcatacactttaatataatttcattgtctgcctttcccaccaaaccataagctcatttttgccttgttcactgcttttgcccagtgcccaacaccaagctaagtgccagcaatgtagcaggtgttcgaggagtaagagccaaatgaattgtcagaagttacccaactgacaggttggatgatttgaacccaactctgtgtgattctgtagtcctgtgttttccattacatcatgcttccttttttttaatgttaaaaactccaaagtttctaggtagcaaaactataataaacatgtattttgaggaaggataggggaatagagattttctttcctctcatttcaaagtgctgtttaaaaattttgcaatacatgccttaaccattcactatatttatctacttaatgcttcagcctgatgttataatttagatttttgtgtgcatattcaaataattggtcattgaatttaataagcccaagagaattagagtaaactaatgtgatgtataaatgcaggtagaacttatatgcatttatacatcactggattctgcaaatctttaaaaatgtacctaacactttcagaatctgtatttcagtgattcccagctgtggttttggcacaccctaagaatctccagttattttgaatgatgacataaaattctcagtttttttttcaaattaacttttttggatatttaaaagaaaacatgccacatgatgcattgcgggggaataagaaacaggctagatcagaatggagccaatgcctttgacccttgggaaatcattgctatttaatcttggtcactgctgaaatatattcagggattaagaaccttaacaagaatttttgtttattctttaaaaaagttttaacataattattaaaaattagtagatgatacttgcacaaagtataaaattcacaaaaatgtctaagtgaaaaggccccttccacctttctctcatctcccggccactctagagataatcagttttgcatatctttctggaatattctatgcatacgcaaatatatcattttaaaggtattatttcttggtaaaacaccggagtgcacactgactcataaaggtcaattcgttcacttttcagtttaagcaaagataaaaagttataatgagaaattcactacatagaaaccaaaggcacaaagctttgaagtctattttcttgtaaaactattactaaacattgtggtgatatactgtaatgaaatatggtactaatgaaggagaaatgctgcttgacttatgacaataatggtatccagtgtgggtcctgaatcttcctgagttttctgttctgattaactcctagatgatgtttctgtgtggcgatttatctcaataccagcaataaagaagccaagctgataggttccagtcactgtagggaacttatgtgaggaaacttactgctggtctcttgtcactttctcacccgcctcctctagtgaccttaagttgcctacagtgtgcaaaataatgtaaagacgataccttttatatcaacagacatttctcttttgactgtaataggtttgcagaatctatccgttatcgtcaaaagagaaatgcctgttgatataaaaggtaccatcattacgttattttgtgtggacagggcttgatgaatctttggatgatgattttagtgcaagaaaattcacaaagcttcctgcagttagtacgctatatttttttttattgtttctggcttttgaataatcagaagtgatcgaaccaagaaattaaaataattgaattgcatttggacaagcctacagataaactgggtttaagtagttgcagcatgagtatcttacgatacccaaggagtacactagccaaggtcctcgtcagcttttgatagtttatatttagaatttattgagccctgcacatgctcggctctggagaaaacttggtggcctgtgaactgatagtcttcagttatttatcatctcattttgcttatcaaagacttgcctacagtccctgtggcttttcttttcaccaagggcttgccttggatggagacagactctcatgctcttctcttatgactatggaaggcactcatgtctgagtagagtgtgattttcttctggaatgtgtctttggcaaacaaaaggacgaatgccgtggaatgttctggaggtatcatctaagaccacagtaacctttagtctctattttaagtactctgttccattgtgttcacttgtattttgtgtctcaatttttggcttagaaaatataaccactagagctggaacaaagtgtctctagagttgggcccaactctttttgctttccttagtggaaagataattttgtgttttgtttttctggacctggatcattccattgtaatgatatgttggatcaattgattcctaaggccccttctgtctttgccattctccgagtctaccatccaagctttggagcagtgcttctaaagtttttctaccaatgtgtgtgtgtgtgtgtgtgtgtgtgtgtgtgtgtgtgtgtgtataaatgtcttcatgatatcaagctctgaatgaatgtggctataattgatatgacaaatgaagacattatgtctgtaaagacaaattccaattagttttgatatatgagttaattgattatttccccttttattcagcttaaatgtagaaaaccttcccctctgaaaccttaatacgatttgagttttccctctcaaggaatagctcttcatgggccagcttctatttgccatcacggcatttccaaaagtctgcctttctcctgctggcgaatgactgtgtgactgacttcaattattcccctttccccattaatttagtcagtactgctttcttttacagcaggaaccatgtgatactcatcttattggacttcctcctcccatgtcaagtgtttgcatatacaggttgagcatccctaatccaaaaatccaagatccaaaagtttttgagccccaacatgagggaaaattccacacctgactttcatgtgacaggtcacagtcagaaagcagtttattcagcatcctcaagggaaaaataaaattaccttgatgctatgtgtataaggtgtatatgaaacataaatgaattttgtatttggacttggatttcacctccaagatatctcatcaggtatatgcaaatatttcaaaatgtgaaaaaaaatctgaaacatttctgatcataagcattttggagaagggatactcaatcttctactaggcattcagaaaatggttgttgaattaaactgaatttctgacaatttcctacccctggaatccttcagaccttcctccaaagaaactttctggactaactctattcaaactttgcattcccttaatttgcatttcataacacttctgtgcacatggtttgtgtcatattaacttgtgtggttatttgttcttgttattccttttgaattttatgtgaagtataagggaaaggtacccagacttggagtcaggaaatttggttttctttctttttttttttcttttttttgagataaagtctcactctgttgcccaggctggagtgcaatggcacgatctcggctcactgcaacctctgcctcctgggttcaagcgattctcctgtctcagtctcccaagcagctgggattacaggcgcctgccaccacacccagttaatttttgtacttttagtagagacggggttttgccatgttggccaggctggtctcgaactcctgacctcaagtgatccacctgccttggcctcccagagtgctgggattagagtcgtgagccaccgcgcccagctgaaacttggttttcatctttcctaatatgctagttgagtgaccaaggacagtccattcaacttccatggatttcaaatttttttatccaaaagatggaaggagaggtgaggcagaatggatcaaatgattcctaggattctttctaaccttagcattttgatttttggcatattcattccctgacaaaatcacaaacttctcaaatgcagagaattgcctttctctactatatggaatatatacactgcttgacacagatggtgcttaataaatgcttccttagaaaatgactgctgttctacccctgctagcaagaagttaaacctgagggtgcccctcttatagcccatgtcctaaaggggctctcagacccatgctgggaaatgctatcctggacttagacatcagaaactgagactagcacactgtattagtcatgaataggggcacacctaacagctttgcctttttaagtaaatgtgtttatggtttgtgctgctttcctcagtaagatcatttccttgcacgtaatgagagctgtgtgtgatatggttgaaatcctgtccctcggctgagatggagaactcacgtgatgctgagtggggcccattatcccaacggcactcacaggaatgctaagtctggcaaatattaactcgaaccacagcagcagttaggaggcagcaagcagtctacccaccttcctgactatcactttgggtttttctgatttttctttccttggcttgagcattgtgtttattccccctttcattcattcttcctcttctcttagaaagcaaaaacaagacatatttcctccattcatctctgactggaaactctgatgttctcattcatttcagacagaaggctttccctcttttgcctaagcgatgtacaacatgtttattcatcctccctgcctccatgccataggtctgggcattggaagaactctggagtcttccaaaggtcttggggaacagactctcattgcaggcagctatggatagaatagatggattgtgaaagcctctcaaaaccaatcctgtgtgctagagaagctttccttggatgaagagaagcatatgatattttcccatgtggcagggaaaggagtgacagatgagatggaagacacctaacacacatctgaatgtacgtaaagaaaagatttataactaaaagggaggagttgtggtttagattaaaaccacaaaggaagtgaaggacgttaccactttcctctttgtgggtagaagattctccttgggctcatctaatgggctctgtgagactgagtcttcctataggaatatgtttatccctcctacccttctagaaaagcatcgtgcacagtggtttgtggtcttaaagagtttagacttaattttgaaagcataaacatgccataaagcacctccatttctaaatccattgtcccaaacatgcttctcttattgtaaatagaaaagcgaagaattaaagctctctgggaaatgaaggaaaggaaaagcccctttcccaagttacctaagcaatttccctacctcaccttaattttcctttgttttcctggtggagaccttgtgcctgttttgacttagcaaaggaaattattagtagctccattcctctaatagccaccataattgaggacctactatgtgctgggtatttttcttgtattatctctgaacttccaaaacttctgagagatagattttattactaccatttttaaaagtgaaaaaaactggggctcagaaaaaaccattgcccaactatgacctgaagccttgcatccaggtgtgtttgatgataacactggtgctcctccctgcctcttcttcaaatctggttttagaagtattttggccatcggtgtcacaaacttggaagtgggtttgaaacctggttctgcctctaattaccaatgtgaccctgggcaaattatttgacctctctaaagtcttatctggtatgtcttgtctggtatgacaattgcttagataacactgggaaaaggcttccttattggcttcttcttagaattaaatgaagcaacagatgtaaagacatggcatatcaactagcaaacagtaaactcccaaaatgacagctatacgctaattgtgtgtaggtcagtttctagaccaaactgtgaaatagctgaactccgcttaagggaaccctctgttttcttaaattcctcatcctcattcctgtcactctcagcttctagaaaaatgcatcaaggtgtaagtggctatgaacacttggaagagagaagtcatacttcttcgataataaaacaaaagaagcaagtgctagctgtagaatttcatccttctaaagtgtgaaccgaagattgttttttggtcttttgtttgggggaaggtgggttgctgtagggtaggaaaaaggaaaccctgtgagtccccaagccacactgtgcacaggacctacggcagctctttaatctcatgcttctttttctggatacattcagtgtagggccagttgtagattccaggtctcagctgcttttgatcagaacttttttttcttcctgtggtgatcttgcatgaattttagacgctggcgactttctattgcctgagtctgtttttcattgcagatatttgtcaggtttttacatctaggttgcattttgaaagcttttctgcttttcttctctgactattctctgtgaacttctgattctggatttttttccaatttattttaaacataatatttatacattttcctgattacaaaattaataactattcattgtagagaactaaaacaaaagaagaaaagattttaatcacccataaacccagcatccagagcacttttcacattttattgcattttcttccatcctttctctacacatatgtttctgtctatataaattgtatgtatgtatatgctttgcaaaattgggataagaccatgtatgcattttgtatcttactgtttcatataactttatatcatgagcatttcttgcatgtgataaaacgtttctgtgaaagatttatgtctgcataatatttcatcatatgaatgtaccaaggtttatttaacctttcctattctgctctatgtttagatgtttctttgtataaatttctgtccaagtttctccatttccttttgctttgtaacttattcctagacagggaattattaaggcaattagggcaaagagtatgaacatttaattttttatttaaaaatgtatttatgcttggttattttaatacagacaccctgtgtatggccttttaaaagcctcttgctattagtgccaaattgatttccagaaatgttcttctagtacagggtggcaaactaggacccgagggccgaatctgtcctgtggcttgtttttgtacagcctatgagctaagaatggtttttacatgtttaaatgcttagggaaaaaatcaacagaataataatactgcatcacatgtgaaaattatatgaaattcacatttcagtgtccataaataaagtatttctgaagcaaaactatgctcattcatttacatattgtctatgactgctttcaccgtacaatggcagagctgagtagttgcaatagagactgtatgacctgcaaatccaaaaatatttacaatctgccctttacagaaattgtttactgatccctgctttagtatgtaatcctacaagctgcatatgagagtgttcatttgaccacacacatactaacactgaacactggaattttttaattctttgttaatttgagcaagtcaacaaatatttaccaagtgtttgccacgtaacaggccctcatgaaaaatacaattaacttagcatttctttgattactagttagggtgagtttttccataagttcatgtaaatttttttgtattcacattctgtgtatatgaaatattacatttcaactcaggcatttacatttttcatacccctttgtatgagctctttatatactaagaatattaatgtcttttcagtcatttgttgaaatcatagttgttggaaatattttgcttttattagactgtttgccttttatttatttatttatttatgtatttttactttttttgagatggactcttgctctgttccccaggctggagtgtatgggtgcaatctcggcttattgcaacctccacctcccaggttcaagtaatcctcccgcctcagcctcccaagtagctgggattataagcatgcaacaccatgcccagctaatttttgtatttttagtagagacggggtttcaccatgttggccaggctggtctcgaactcctggcctcaggtgatctgtctaccttggcctcccaaagtgctggaattacaggcgtgagccactatgcccagcctagatcgtttgccttttaattttatgatttttttttacatacagaattttacatttgtatgtaatcaagtctattcaatttttaaaaatttttggccaggcaaggtggctcacacctgtaatcccagcagtttgggagtccgaggtgggcagatcacctgaggtcaggggtgcgagaccagcctggtcaacatggcaaaaccccgtctctactaaaagtacaaaaattagctgggcatggtggctggcacttgtaatcccagctacttaggaggctgaagcaggagaattgcttgaaccagggtggtggaggttgcagtgagccaagattgcgccactgccctccctccagcctgaatgacaagagcgagactctgtctcaaaaaaaagaaaaatttattttaagaatatctttccctgtccccaagttcagataaatattcacctttattttctttcatttctttaatggattcattttttttttttgagatggagtttcactcttgttgcccaggctggagtgcaatggtgtgatctcagctcactgcaacctctgcttcctgggttcaagtgattctcctgcctcagcctcccaagtagctgggattacaggcgcacgccaccacacccagctaattttgtatttttagtagagacgaggttttgccatgttggtcacacaggtctccaactcctgaccttaggtgatccgccctcctggacttcccaaagtgctgggattacaggtgtgagccaccgcacccagccggattcatttttatatttgcctctttcatccctctgtaactttttttttcttcaactctggcctacagaacctctggaattatttgttttatagtatgagatgaggatcttaaattttcttccagacagtagcataattattccaatgttatttgttgactaatcttttttttaatccacttatctgtgatgtcaccttcatcaattcccagttatgttcaatggtgtatgtgtctcttgtttttgttgctgattccttgtggatgtccaccttattgttcctgattaggcctacacagaatacagaccctggctggattttcagacttatgtcttgtgtgcgcctcccaggtactactcctttgcaactgtaaatttcagtagcatctttccttcttttggtcaatttgtcaggaatgcagtagaagtttagctcctaaagtacacaaatggtaaggaaccttcctactaaacaagagatgagggccagggccggcccttgcacataggtgaaccatgaaccgtggttctcattcataaccactccaggtgacaaaggctctatttgtaacctcggaggttggaggttttctggccaaatagcatcaaccggcataaaaagagcaaatctctggaaggggctcccagaagagctgttacatgatgcacagcccctaaccttctgttaatggctcaccccaacccaaccttggttcatagtggagttatttcatttaccaggtgtgaaaattggattttaccacagaggaggggagttattacctatcaggtctgctctttaggggagcggagattgtggtgggatttattaaaagagatttgctatgcatggaacatataattagagatgtgttcctttaaaactggatttataatctttgtcattttagaaatgcagttttttgccttctgtttttctgacagccttcttttccatgtaggttgcacacaacctacctaggatctgaatattttatatggcaccattctgccaagagacggacctcaggggtgtgacatgtgacaaagagtacagcttggggggattgtggggagtgcctgtagtatggatgctgatattagtcacacaagatgctaacgatggggaggggatgataaagtaattttcatgttaattaattgctatgtagtccaggcctcggtttcatggaggtattagggtcattctgagaccctctgatgagagtactcttgaaaatcgagttcagatttaattacctgttgttagaggctatataagacaacctcaaagttagtaccggttaactacacctgcttttaaaaaagacaccttgtttattattatggtgaactgggggtggctgaatttattattgtttagcatttctagcacactttgttcttgctgagtgctttaagcgtttttatgtatttatattggttgctcttcgcagcactcccaagggatgagtgggtgataagttttattatcacctgcttttccaaggaggaaacagaagctcctaagaggagaagggacttgcctgggtttatagctcagagctcctgccactttgttaggggatcctcaacaaaatggtgataaattcagcccttgctctgcctgctctcagcccacgagtaccacctgtgctccatcctgtatcccactaactacagtgggatgcaaaataaaaatcatcactattattggcctctctgtgcttggcactttatctctcaactgatcaccttcctaaactcaccttattaactctgcttttcttttaaaagctctgccgttttccccacagcccagcttagctccctaaagtcatgtgtgactcagcctttccacccacttcagttgcccagggagccatgtagattctgccacccaaatgtcttacatctgtcccttccctattcttccccctcccactaccaaaattcagtcctcattaccccctacctggactactgtaatagccgtttaactgggtccccacactttccatcctaagttcttctgtctggtaaaccttcctgaagtaaggctctgataaataccactctcccactgggtccgttctcaggagccttcccatttaagtgcagattcttatcctgcactcagaggtcaccttcctttttggccttctcgcctactaagccactgaacaactttactgcgcatcaagagcttggctagcaggcgcctgccgtgagcaattctgatttggcgggtctgctccggggccaggggacccgcccttaataggcctccatgtgatcccagtgctcgggaccctatggaccacacactgctctcgcaggcttttcccaagcccgtagtcttcagcccctgtgcccggctatgctgttcttttaccctgaaacgctctcagccccctctccacctgttgaaatttttctcatgctttaaggcccagctcaaatatctccttcgtgaagcattttctgattgttccaaatggataagatgcaaactccttagccttaaatttaagatgctctgttttacaattccaggcccatctcctgccttcctgcctggttcctccgctatccctaagcccaccacaccgaaatggttctcagcataggccctttacacatacctccgccaggaatgtggttcgttttctctctctttctctctctctctctctctatatgtatatacatatctcctctctccccacccaaccccgtctctcctaaacttaccctgctagacccggctcatatgtcacttactccgtgccacattcatcacaacgacagtctttctagactcttccccgcccccatagccgctaagtcactccctcccctgtgcttctccagactttatacgcccgagagaacccaacgacagtagcttacttgtggtttatctgttaatttgaacactaggcagtgaacttggctcaggctgtgttctgaggacctagccgggagtccacaggcagtcagtccttctagaatgcacgcatgaatgaatctcttgcttcccagccgcccctcccccggaacaggctttgctctttgcacctctgccgttgcatttctcttcctgtcttttttgtacttgttttactcaccgtactagattgcaagcccccttgaggggagaaacctcgtgggattttgctccctattcccaagtctggctccttaaccatggcaggaggtcaataaacgtttgtttaattgagttgtaggatgttgtgcccggctagctgctaaacaacctcatttaaggggttaactaataacactcagagaagttcttctccttagggggcatttgcattttaatgggaatcttaaaaacccaaaggaaatgttctctaatggtgggatttcaggccttgtagtgaggcctgtgtgtgtgtgtgtgtgtgtgtgtgtgtgtgtggtgtttgatggggattagggaagagttcctccagcccaggggtatttcaacttttctgtgtcatgggcccccatgagcagtctcgtgaagcctatgaacagaataatgatttaagacacataaaataaattacgtaggtttacaaaaataggttataatgaaatataatgatctgaatattaaaaacgtcaagtttgtgatatagtaatatgtgcttctttattagaacgttaattaaaaagtctactggcaggtcttataattattgtaatgtcatagtgatgactataagcggtatttgggatatctgtgattctgctggttaaaaagtcatgagctgctcataccaccttgatctgttgcctggatccataattgaaggaaatgataattttcaactagaagttagtggaagcaaagatgtattttttttctgcatccaagttctagccctagtttccgttgcggacccagggttaagaggcctgacttggccgaaccctcaatatgatgtgggtggtcttgaagccagtgccattttggatcctaggcttcctttcctactctccactactttgaccttaaactctcagattcttattttttaccctttatttaacaaaaaacgacagtatacatttacttcatttacagaaatatgaaataaggtgaaacaaaaaggattgtttgggttctccctccatcagccaaggcatcaagatgtcagactatgggagaaagagaggctcactagtttcctagcctgggagcaccccctcccagaagtgctatccatggggcggggtggggcgaggccaggaggaagaggaggatttgtcccaaattcagaggtgggaaagcagttgcagaatttacctgagagtctctgctggctctttctaaattcagaagtcaatactgggaccaaagagcgtgattctaggggtggtccagcatcatatccatcttggtagttagtgactaagtgaaatattgcttttgagaccctgcactccctaatgctgatgtgatttctaatttaggttaaagtgtttgtgcagttctctttttaaacccaaaatacagggaacatattcaatcctttcccagttatctttgtgtattttagtcatttagaggcaattttcctccaggcagatttaccctactgtttgccatgccttggggcttatacctctgctctcagtggatgcatgcttggaggatatcagtgaattttaatattagctggacatgttgttaccagggtgagcaccatattagcccaggcaaaccatcatccctgtccctaatggtagtgacactgaaagctttacccttgacatcttccttttctcttgcatatgttttcctttggtgagctcattcattttcctggcttcagctctcacctctgcacctccagcctgtcctctcacctggcaagacatctccgttttggtgttcagtcacccataattctaaaactcgacctcttttgtcttctacaaatcagcttcacttttccaaaacacagctttattgaggtataatttacaaaccataaaatttacccattttaagtgtatgatctattgatttcttgtaaattgacagtgttgtgcaaccaacactaaaatccacttttaaaacatttactttaccccaaaaagatccctatactatttgcagtcgatccccattcccaccccaactaatctgctttctgtctctatagatttacgttttcaggacatttcatgtaaatgaaatcatgcaatatgtagtcttttgcatctggcttctttcaggcttcttctgcttagcaaaggggttttgaggtacatccatgttgtagtgtgtgttagcagttcatttcctattgctgaataatatttcattgtagggatagaccacgttttatttaaccattcttcagttgatggacattcagattgattccactttttggctattaggaataatactgctatgaacattcacatacaattctttgtgtagacatacatttttatttctcttagatagacacctagaagtagaagttctgagtcacatggtaaacttacattgaactttttaacaaactgctaaactgtttttgaaggtgactacagcattttacattcccaccagcaatgcatgaaagtgttagtttctctccattctcaccaacacttgccattgtctttcttttttattataggcattcctagctgatgtgtagtggtagctcactgtagaccagtgtcattttttattttatttttatagaaacgaggtgttgccatcttgcccaagctggtctctaactcctgggctcaagccatcctcttgcctcagcctcccaaagtgctaagattaccagaatgagccaccagcacatcctgcctagtgtcatttttgaattcatctcacttctgaccacactgcccctgctttccaccaattttatggctagaaaccaaacttacactattcttccttcctcttacatttatatgctgcggaagtaagctgctacaatcttcttcagctagcacctgaatttcctacttcttcatttacctttacattgccctacctggatctgcatcatttcacacctgaatttctgccgttttctggcttctctcctggcttcttctctcttctctcttcttctgcctgttgtagctctttcttcaaatcttccttcctgtagctgcagactgatggttaaaatagtaacatgaaaagagcatgcgtggatatggaattggaggatctgtgttctagttcaggaatcaccacatgaccttgaactagtcttgtaacttacctgaacccagctcctttattaagttacttaacctctctgagccccagtttcctcatatgcaaattaaggataattgtagaacctttcttatagagttgttacataatacatgcaaagcccttagcacagtgcacggatgtatgaagagcactcaatcagtgctggcgaatgttgttattttaatgattattatgcccattattattaatcgttatgatgggagctatctactacgcctatcatatggttgtcataaggatcaagtgtggctgtgaatataaaagaatactttgaaaaataccatgcaaattgcactgatgttatttttacatgtttttttcccttgcataaggagaaaggcagtgcaggatagcagcaagaatacaggctttgccattagcctagcattcaaatctggactgtgctttttaactgttgagaggcttgaacaagtcatttaccctctccatttgggttttctcatctgtaaaatgggtataattataaatcacattcaggataatgctgtcaggatggtgcctattccataggcagtattctgtaaactgtagctttttaaaaaaaataactcagtgtattcttcttatatactttatctaaattatattcttcataattaattcccaccttatttatctatctgtattccccactgatcccaacacatacattgaagagaggctataatgtggaaagattaaacattttcacctcaggctgactttggctttaatctcagctccaccactctctagacacatgactcagcacagttaccttaccttgttaagtatctggctcctcaactgcaaaacagttgagggagagcaattcatacctcatggggttattgcgtatataaataagatcatacaaagtccttagaatagtgcttggcacatgcacatactaaatactcaataaacagcgactgccattatgtttgtttctaataacctttaccactatcattttctgattcactgcccacacatatgctgtgctcctttcagtctctggcttggctccttgtctctccctcctggccatcctcccctcctggaactgcccaaatcctattcttcaagccagtttggcttctgatccttcacaaaattatcacacactagtccagattctaatcattgcttcccgtcctgccctcccactccccagaaatctatggtttgtgcggtgtctgtaattctgtttagaaattaattattaaacatcttctgttgtagttgtttcctcaactggactgtaaggttctggaggaggggtatttatccagcttctaatgaagctctcactctgcttagtttggcactagacacatagtaggtgcttactaatgcttgactgataaactataactaagaaagcaaacatgtaaaagtcactatgagattttacaaacaggggttccttaaccacctggatagtgtcctcaatgactgtgaatcaagagtgatcctgagcagtgttattccaaaacactagcacagagtagagaaaagagcagttgatacagaacccccaaatcaaggtcagcactgtttaagttagcaaagcctgtctttactggcacagatgaccttgtttttgttttcctcaccacttcttggcatctctcgccaatctcaaccactttttgcaatcccagaggacttgctgccctcagaaagccctctgagtatctttccttctatcttgaatttctggggagagttctccaagcttcaaaattagccttttctttcttcccctcaatattccctcagtgcagttagcagttaaggaggatagaggtctggccagataacttattaaaatgaaagaaggctaaccttttattatgttatccacccccaagggctgggggaagtgacatcttaaatccaaagtatgaacttctaatggcagaatttaaaagagtgtgtcaggagagttgaagagatatcagtaagtgatgttgggtgtgagaatgagtaaggtattgaggggatagcctttcagtgtccctaaaatctccccacaggccaattccattttggaaaatccagagatgaccaaatgcaataataagaaccaacatttatcgggcacttaactatgtgctaggcactattcctacatgtctacagtcattcatttattcccacactactctgggagacaaatacctattaccagtactccactttatgggggaaaaaaaaacctagagaggttaggtaatttttccaaggttatatagcctgctcatggcagaggtaagattcaaaatcaggtggtttccaccctgaagtgggtttttgaatcacgcgtctccccttgtaagcattctggaaaaacagaggaacaaacttcatgagaaacaaacctagatattatcattattaccatcaccatcatcatcacagcaagcaaggtgctgtccctgttgtgtgcagggcactgcacgaggtgctgagaagacaaagaggcatccagccccactgcatgcctgaatcctgaccctcagattgcctcaagtgcttccacctccatgaagtagtttctgctcatgtcttctccctcaaataatgtatctcctatgattgctgatttactttttgcttctgctctgccatttatttatttattgccttctatcttgcattgtggttaattatatacattgtcacacatctgagcctttgcacattgctgagtcctttgcctggctgactcctacgcattctttaagattccactcaggtcttattgcatactctgactctcctgcctgaactagatacctctcttctgtacgcccaaaacacttggtatttattcatattatgccacttattataagtgattataagtgtttgcttgtcaatatttttaacaagctagatcactgatcccaacatcaggggagttaagttatacttttttgaatcttcagtactttgcacaatacttagcacatggtaggcacttagtaaactcttttttttcttattaatgaatgagccctccatacaaatttgattatactttgaaaacagaattgaatgttggattcattttttgtatcccccaagccctgtacttagtagttgctcaataaatattgcaatgaataagtaattgaaaaacaaaagatatgtgagattctgctcttgggatatgggggaagactgggacctagagtaaaatttgcctatctaggctatatttttaagttgattataaaaacatctaccactaaaatagatgaaaaagaaaacattgtttttgaccaaaattacttggctacaaaaatatagtttaatatctaaacccaggtccatatgactctaaaaccaatattgtttctgttatacaatactgttgagatcttaaggtagatagaggggccctcattgggctcagcagaaccagtagggcttaaataattagaaaggaatagacaattcacgaattatgtaaaaaatggtggtatacataaaccactttttaaagaaagatctatctggcaagagcatgtagaattgactgacgaggggagaggctggaggcaggaatatctattgcaacggtcccatcttggaaacagaaaacaagaaattgatttaaggaggaatttgtggacactggtgatgagaggagacaaagacagaagatgttgagccaggattaccacagagttttaagcctaagtgaaagatatagggaattcagaagtgagacttaatcttgacagatggtgagtttgctttttgatatgttaagtcactttagatgagcaagctgagtagatagaaatgcaggattaagttcaagagaggcctgagctagacttgtagatgtgctggtcatagttaaagttctttaaacttcaaagagatgatagctaaagttaggagagtgaaatgacttagggaaaattggagagagacaagatcaagaacaaacaactttaaagaacaacaattaagagacaatgggaagaatttaaatcaataaagaaggcaaaactgtatcatcacatcttggaattaacaactaaaaagagattcagggaggaaaggatattcattatgtgaatttggcaattaggtttggccatattggacagagcattttggtagaatggttgggttaattacagaggaggaaacacaatagttgtggcagagaatgtaggttgccctttggataaattgggaataaaaagaaagggggaaaaagggtactaatgtaagaaaaatgttactgaagtttctaaagcaaagagtaagaagccaatggatgggagaagagtgagcagcgtccttcagaggtgagatgagatgacaaggttggtcttgcagtgtagaagaagtgtggatagaatttggagtaattgctgtggaaaatgatagcggcaacaatgaggatacataaaaggattacaaagtggtaagtaaagatattcagcatcatcaccttaattttggttgggatccattttattggcttcatgttttttctagcaaggtctggttgaccagatgtggaaacaaggaagtgaaggtacatcttagcattagaaatttccgtggccagaatggtggatggtcaaggattctatggagacaaagtggccagtgggtgcaacctgaatgcaaaccacaaaggtgaaatcaaggctgaaatagttgggtagtaattctagagaaactgggaagagattgattgtgtgagctgggaagagtccagtagcacaggctgaaatcaggaaaaacaaaataggtcatctggagggcaaaattcctagggaaatatctaggagaatgaaacaaaatgaagtagtagaaacatccagaattattgttgggaaagcagttatgaataagaaatgagtctgggttcactggtttatgcctataatactaaccctttggtaggccaaggtaggaggattgcttgaggctaggaatttgagaccagcctgggcaacatagtgagactatctctacaaaaaataaataaataaataaataataaattagtggaaattgaggaagaaaaggaaagtgggattctaagaatggatgtgaagaactggtatgaaggtcaagagatttggagataaatggttaaagcatgtggaacacgtagattgtcccttggtaaggcatgatggacaatggttaaattggaaaagtggggaaggatcaggatcattatgtcaatcatttaggactcaggaaatgagaatgtcacaaaacttgaattttagaaggtagagtaatgagagtaggaggcacaaccataaaggtttgagcatgaaaacaaaggggaagcattggtggtgccttcttatgggatctgagtgtcacttcaaagcttcttaagaatggtgactctgattctcaagttgtgaagagcaggtatgtggtgacacagaacaagactcaagctctcatcgaatgccaagggcctcaggtgaagctgcaggaggaaaggaggtgggaaaattgatttccacctaacgaaggagacaattagttttaaattttccagccagggatgaagctctgggactcccccattgacttcaatagactggtgaaaggtaggataaggagatttgtttcttttgcctggaaaacctaaaaagaaataatttcctggctatgttattacagcattggggcacagcactatgaaagtcaagagattagattgactttcttttttttttctttctttttttttttttttttgagacggagtctcgttctgtcgcccaggctggagtgcagtggagcgatctaggctcactgcaagctccgcctcccgggttcacgccattctcctgcctcaggctcccgggtagctgggactacaggcgccggccaccacaccctgctaatttttttgtatttttagtagagacggggtttcaccgtgttagccaggatggtctcaatctcctgacctcgtgatccgcccgcctcggcctcccagagtgctgggattccaggcgtgagccaccgcgcctggccgagattagactgactttctaatggttagatgctattccattctaacccatcattttcaattattaatgactctcttggtagtattcttttggagctgaaattcaccagttttggtgaacaatgaggtagatgaatcggtaataaatattaatagtacaagcagcaggagcccatggacaagctgagggctttgaccaaggcaagaatttgttaagccctcttataaccctgatactagctggctgagtgggctcaacctttgttagtcttggtttcatcatttctgaggaagactttcatattctctcctacaataataaatattgttaggaatgaacaatcattggaatttagaatactgctgtggagtcttggactcaaattctagtccctaaaactgagcataatcttggcaaatcattgaacttctatgccttagcattctgtaagacagaatggaattccttccaatcctaaaatttaggtgtaagtttatcaagaacggaggaaacaaaagcacttgttgcctcaacttgaaagtggagtttacaggtggaaaaactggaggcaaacctaacataaatgctacgattagctaaagaactaagaagtcaaacttacatcatctatgtttgcaacacagtgagtgctcatcattatgagaagcaaatttcagtaagtgagaaaatcaaaaccaagtctctttagcatcaaaatcctttatttttagcaattttaccatttgggtaaaaaaatgatttcttatcttaaaatttctagagtagcagtaccagtttgaagctcttattcataggatgcttttaaaaaagcatttcattatccattaatgtttatgtatatacagtgtgttaaatccttatacaccaaaatagaattctttctcaagtgagatgaaaatgcatacaaggtagaaaattcagagggcaaaaattctagtaaaataacctatttaatagaataaatcctagtttaaaacacatttctatcccatgtgcaatgtagctaaattaccatttctatggaacctctaacctttagatttcatgactttttagcgtgcttaaattctcaatagtattattcttttaccctagtgtcgtatgtttaatattcatttgcatttttcttctgattcaataataattttgaactttgacacataatggctgcatgagggcttaacgcttagtaaaatggctaagaccttcttttaacatgtgtattattgttttaatgagtttgttttgagcttgctgagcagaggtgatctggtctgggattccccccaggccagagcttattttggcagtggttttctcttatagacaagttctgtgagttccttctttccacctacattagcaatcccaaatgtttcttgcatattgctgatttggttgtcttttctaataccataagaaaagtccgtaagtccatacctgactttttcctcctgccttcttttacaggggttcttagctatgttacatcaaatattctatgccccaaacttgacaaaaggcattttaattattttctatttggaattcttcaattgatcttgatattgtttataccaactattgcctttcttctttatttaatttatatcctcagtcatgacagaagacaaagagaaaataccttgccacagtttttcataggatctaagcaggggaggcggctatggtaacttacgttgaccagttaaagagttttaaatgatttcgaaagcagatcggctttatcatttagggctctcttgaccatcctttacaactagcaccattccttaaaaggttgcccaaggaaggtttcctttaggaagggaaactgacacaggaataagtaccctggttaaaaccatgggtgatagaagcaagagcagaagatttatctcgtcctcctggccatattgcctccatctgtctccagggagaacacgcagtacactctaacatgggcagtcttcacctaacggatccagaagagctgcggggtcagtgcacacagttgccgaagcagctaacttagatcaagaccccacaaggcacaaggacagaggtgtaacaacagtgtattttggggagggtgcagagcagacagatctataataacggttgttcaccgcagcaaccggggccacacagatggagcagaatagcccgaatctgagctttgattcagcaacatgctctaaccatgatgccgtcattttttccttctgagaaaaagtgtaatctaatgggctaccctctcacaacagcgccgggatactcaggctttgaccccttcagagcagaggtcttccgaaaaattaggggagctagcccggctgtgaagcgacgtgaggtcctggacagaggttccctctgtgggcaccaggcagcgatgcctgagccaggctgggctgggccggatgtgaaaggagacccctgcacccccggcgcatcagcgggactcctgcacttcgcagagggcggaggagagcgcagtcctgggtgggggctgctctcctgcgaggggagaaagccggccatggcccaggcggtgcagactcagaggtggagagaagggacaggaaagcggggtggaactgcgtcccgaaggtgtgaggaggtggccttgaaggttgagggctaggccgggacctgggcagcagggaagagtgagggaaagaccggctcttcaattcgtttctgtcaaaagatggccaaattccacgctgcccttccccctccgcgcctttcctggccgccccccgcctcggttgctcccagggctgcgcgaggcggcgggaaggtccgggagagtgagcgcgtggggaggaggggacgggaagaggagaccctcccgtgccgaacctcccgccccgccggcccctcaggaggctctggagttggggactagagctctgccgctttaaggggggagtgggcgtcccctccagccgggtgacggtccggggcgggccctggcgggcgtgcctatgcaaaccaggaggtggtgccggcggtgggcgggcccgtagtaaaatatcgggggcggggcggcgggaggtgcggctgcctggtgggcagggccctgcgggaagctgggggcgggaggaggccgcggcgggttggtaccatcgcgcgcgtctggggagggggacgagcgactttccctgaaggggcacgagcgactttccctggaggggcgggcccttgctggtcgcggggccggacgctgaggcggggcggggcggtcccggttccccgcgggcgggacgtcgggccggtggggagggggcaccctccgctcgcgtccgaggcggggccggctgtacctttcgtggcgcggtgcggcgggggagggccgaagggagggaaggggcgggaccgggaggggggagccggaaagggggaggcgccggcggacaatggagcctatgtgtgcttgccggagtgggacggcgccgccgccgccgctgccgccgccggggggagacgctgcgccgccgctgccgctggccccggccccgcggggctgagagccgccccggacccaagcctctttccctgctccgcacctcctctcccctcccccactcctgcctccggggtaagtggcacctgggggagggggaggggaaggaccggagccgggggtagtgggggccaggtccgcgtccgcgtgttttgagccggtttgggggcaggggtagccacagccgcgaagagcggggtggaggggggcagaaaaggggcgggggccagggttgcggatttagtgaggcgagtctggaggaacctgtggggggaggtgggggtgcttcacgggcggtggagagagagggcatctcttctttttttcaaaggttgtgtcccaagcagtgcttggagaggttaaaccaggagagtgaggacagtcccagggtcctgggatgcaggagtgttggaggggcgagatggagagctaaataagggaattgggattgagtttgatgaggtctgtaagacccctgagatggatagaggtaaaggggactttgcaggccagtgacttgttgaagggtagggggaggtggaagctaggaagaatgtgtgagtagttaagggcccaagcaggtgaattggtgatgtctaggtcactgagtcattgtgggggtcttgggacacaccagtgatttccaaagtggagcctgagtcactggcctttgaaagttgcaaagactattaagatgtcactgatgagtgttgggtgagcctggtgaaatggagatatcctaagtaaaacaacagcagggttggttattatgtccagagggaaggagagggaggggccagaggcctgtaatagtattgctgggggccttatgggaaggctaccaagcatgaaggaggaggccagaaatctgtcctccaagaggtctgaaggagggggaaggaaaaatgggtttttagtgataggagagacttagagcctagattggagtccagctggggactaataaagttactagataagttagagaaatggacataactatctcttagtggagagtctgtaagatgggatagaattgatgcaaaatttgactttgattacagcaaacataggtaaatccctggcagtgatttcagtggggaaatgattttctatgtaaagagttacattttggtcaatgatgggtattggagtattagttagcacttgatatattcaggaattaaatgttcgttttggggcagagatttggatttgtgcactgagcaaagtgatgaattagaactaacagacagtaaggataaattgtaaaatcattgagagatgggaggagggggcaaaaggatgttggaggtaagactcgtgggtttagaacctttgtggaaattgtgcaacatgattgtcctgttttgtgttttctactgaatactagtgattggaaagttttagcaaggagagatgtttgcgtgaataatgtgaaggccctacataaaaatttaagaaagacatccttattcactattgaaaaacacccaaactattaaagacacagatgggtttataagaggagctgttagttaaatggcataaggatgctttgagcaatgaaggttccattagttgtttgagggcttggataaaaagagaaattgtattttattttatttattattatttttatttgtttattttttgagacggagtctcgctctgttgcccaggctgaagttcagtggtgcaatatcggctcactgcaacctctgcctcccaggttcaagctattctcctgcctcagcctcccaagtagctgggattacaggcacgtgccaccacgtccagctaatttatgtacttttagtagagatggggtttcaccatgttggccagggtggtctcgagctcctgacttctggtgatccacccacctcagcctcccaaagtgctgagattaacaggtgttagccaccgcgcccggctagaagagaaattttttttttttttgagatggagtctcacactgtagcccaggctggagtgcagtggcacgatctcggctcactgcaacctccgcctccccatcccagttcaagtaattctcctgccttagcctccacagtagctgggattacaggcacgcaccaccatgcccagctaatttttgtatttttagtagagacagggtttcaccatgttggccaggctggtctggaactcctgacctcgtgatccgcctgcctccgcctcccaaagtgttgggattacaggtgtgagccactgcgcatggcctagaagagaaattttaatgtaaatttgagaaaagttgatatgaggaatgggagtatgagatttggaagttttatgacttagagatttggaattgaaccattaaaacattttgttaataaccatgttgaatataagatgataatggtttcaaaagagatggtagatagacagggaggtcattggctaaaagataaaagaacaatttccatagagttctcattgtataaggcaagtgtatgtcacttgcttcctcagaagtgtctgctcctgtgaataaaagaaaatgctctcttgtttgtggggggaaaagaatacagatgtttcacaagcattataataaactaaatatttgttcatggtgacttggtacagtagttagagccttggatgtagaatcaggaagttcgttctcccattgacttatgtgtgactttgaacaaatcccttatatttctccagttctcccatctacaaagtagtaaaaccacctgccctaaccactcataatggcgtttctgcctaacaggttaatgcctaactgcaaagtgctctgaacatctcttagaatgagagattatgtagcccaactcttccaatttctgtaaaactacagtcttactaacagaccaaattcagctttggtaatgtgcttgatcaaggaacaaaaaggagtatcttgtacatctgtcttgttctgttgtttgggtttttgttttatattagttttgaaaggtaatgcctctctccctttagtggcaagacagtaatagtgatgacaattgtagaaatgtaagcaaaggtccccatggagatggaagatagatgctgctgagtactaacatgggctacgccaaccccaaatgtctgaggccttggatatgtttcctggcttcctggcagcttaattttcttcagctatgaaatagtgttggcagaataacttctctgtctgccttggtgaagattacttgctctagatcagggttttttgttttgtttttttttaaattgagacagagtcttgctctgttgcccaggctggagtgcagtggcacaatctcagctcactgcaacctccacctcctgggttcaagcaattcccctgcctcagcctcccaagtagctgggattacaggtacacgctaccatgcccagctaatttttgtaaattttttttttttagtggagatggggttttcaccatgttggccaggctggtctcgaactcctgaccttgtgatctgcctgcctcatcctcccaaagtgttgggattgcaggcttgagccaccgtgcccggccagatcagggttcttaaccttataatgtcccatgtgctcctttggcaatctagtgaaacagaggacccccttctgagaacgttttttaaatgcacaaaataaaatacattgaattataaatcaaatggaaacagtcatcaaaatattaattgtaacagtatgtttctttataacacattaaataataaaatatagctgcaggtctaatgagactgtaatttttgaagtagtgtatatattatgccaagatatctgcaacaactatgtgacatgaaaatgtcttgtggtttctgttggtgacaaggtcacagaattgctaataataccagggatggttacttccattcgccattgaaggccatgcaaatttttacttagaggttggtcaaaatgaacatctgagctttccccaggaggttcacaaacattttcccgtcccccaggtctatccacagacctcttgggagtccgtgggatcccaagttaagaactcttaccctagaccaactgatttttgaaagttatattatctcatggccacttgcattttaggttttgcagtattttttagcatctccactatgctaagaacaggagcatagagaagacatgaaacaaaagtccatttcacaacctgtgatgactgtttttgatggtggaaaatgttaaaaacaatgattaaaatgaggcttttgtatctggtggcttttgcttttctaaactcccagtcatccattagcgtggttaggcctcagtgggatggatttgggctgcagtgaccctatcttggacttcttgtattttgagttttagtggttttgccttccttctccctttttgacctaactgttttcttactgtttcttcttccaaagattgctttggctgcagagcactggggaatgggtggttttccttggaatcagcatgaattggagtatgaacttttctttttccttatctgtataggactgaatgtgggcccagttggcgtcattctgctttgacctaaacattcccatctgattgggtggcagagatcatttttggaaagttcttccgtgtcccgatgtagaagaaatagcaaattggacatattgaaaggtaaagaatatcctgataagtcagttccttttgtgattcaatctgaatatgttggatttttgtttctgtttctatagggcctcttgtaagttaaaactacgtttattcattattctaagaattctcaaggcaaaagtcatcaaactaaatgcaagtcaaaaatataagagcagttacacctttctgtgagcagggacttgtacaataactcatttcatagggccaaggataaaggcaggtggtgagaagttaaacaggtatttatcataccatcgttgtgtgtgaatgcaaggtaaaggtagcaatacacaagccccaagctcattataatacatggatcaaacagcattgattgagtttcttccaggtatcaggtgctgagaggaggaatgacagtgccctcagagagttccgtgtctacacatacagttttgtgttataacagtttgtgattataatgccgggggccatggaggacatacagaggagagttggtaatcaaggagaatttcacagagaagggacatctgtgctgaaataatattttgggtagccattattccagatggtgatagttgaaattcattttgaatgcttgaattttgtcaaaaatctttagcttgatataaaatttaatttgcttaaagttagctattaaaaggtgacagaggtatttttaccccatgagtactaaaatgtacattaatattttgcttggaccaaggttttctctacatgcccattgcatagtttactttctccacatgttggggaaagattggtttttcctattgtgtactttttctgagaggaagccttttagtagtcggtatgccagaagttaagaatgagctaggaatggaatcctgaggctttttagttccacattctaagtttgatactatgccttttatggagtagtggtcatagcatagaaatgaaatttgttaaacatgacatcgttctaataaactggacttcttagagcagggaaatgggaaagcatcattgaaagagttgaaattggaatcatagaggtgattctgagcttggttagattaatttgtgaatttaacaacttaatggcatgcttctctaggaatccttctaaagattcctaaataatttagccctaagacagtctgcaacttgcttctcccttgccacttcaaaactataaattctgggcaaagagggaggctcagtgtcataattctagtttacaaggactaatggtggaaattgttctgcttggccagtacttagtgttttattgacttagccagctcaattcagtaccgcactttgcacacagtaggcactgaataaaaggaagtcatctggccacattattcagctcttaagttccccacaagtatatgaaaataaatgttcttgctggatgtagagttatggtggagagcagggagaactgtgaatgatcttcactttgtaaattcagagacatatctggaattttgtctcttctcacctttacagtcagctttcaaatctctatactaataaggaatggaaagaagcaaaattatgaggagtttctttctactaaattcccagaattctaaaaagtagaaaacttgatttgcagtttatatttctccagcctctgaaaataaaatgtgcagttgggaaggaggaaaagccacaagagccttgaactggctacagatcagatataatccttcaaaaattgggagttgattctatttgtgtgggggatgacagcttcgtcttaaactgatattctggaataaataagaaacctgtttttctcttaagatattcattgacaaattgatgttgttgatttttttaaaaatctgcttaggacttctttttttcctcgtctagacaagggtcatctttgagaagggggttcctggactcctcacctccaggatgagcactgcagtgtcgtgacccttggggttttggtgagtacactgatggctgatagcactggagcacacgcctggcttagaagaacgagcttagggaaaagcttcagcttttatttaacgatttttttttctttacatcacccaaccctcccgctgcctccccatccagctcctgcccttggtcaccaccattttactgtctgcttctactaccaacttttttagattccacgtataagtgagatcatgtgttatttgtgtttctgtgcctggctcatttcacttaacatactatctccaagttcatgtacattgttgcagatgacaggatttccttctttttaaaggccgaatagtattgcattgtgcatatataccaccttttctttatccatttctctgttgatggatacttagttgatcccgtcttagttactgtaaataatgctgcagtgaacatgggagggcaaatatcacttccatatactgatttcatttcctttgattaacaatgaaaattttttaaagcaaatactatgtgctaggcactatagtaattgctgtgtatacagagatgagtaagtcagttgtggtccctaccttcatggagcttatggtctagtgggagagatgaatgttacacagatgatcacataaattgcatatgtaattacaaagcatgaaaaatgttgaaaaaccctagatgctttaaaaagaatgtaatagaaaattttatgtagattgatggcattaagggattcttctcctctgaaaaagaaacacttaagccaagacttcattcattcaacagaactattcaaacttgatatgggaaagttgaagtttagggagagaggtatcaagaattacttccaaatttctggcatgagcaactgggtggataaaggagccatttattaagatatggaaaactgaaggaaaaaggtttcaggaggaaggctatacacagaattgaagaattcatgtttgatcctgttaagtttgagacatccagggagatgtcaagcaggtagatgtgtatacagatctgctggaatggacctgcaaatttgggagttgttggcatggagagaacttgcagcatgagaagagaagatgactcagagtagagtccagaggaactctaaagttgagagatcaggtaaaaaagggacctgcaaaggaagcagataaagaaggcctggagaggtgggaggaaagctaggaaaatgaggtgttatggaaaccaggagaagagttaacaagaatgaagtgagcaactggcagaatctaagagatggagtaagatgagattagcaaagtggccagtggtgaccttaacaaaaatagtggtcactatgatctgggggtggaagttggtttaaaatgattaaaggtcgaatggcaagtgaggaagtgaaccctgtgtctcgtcaactctgtggagaaatttggctctaaggggtaatagaatgctagacctgggttttgttttgcttttttttttttttttttttttttagcacggaaagattctacagcctgtctgaatgctgattggaaagatccaacagacagaggggatggccagaggggaaaatgagagctctcagaaggctggaagggataggcttagtccacctgtggctggattgacttttgggagaaagtgggctattttttgtttcagtaatagaaaagaaagaggagatagatattgatgaaaattggtttgtgtatttagcagttaagaactttctgcctggcaacatctcttcctattaagtactgggcaagtccaggtattgggagtgggaaggaagggaggaaacggggtacctaggagacgtagaaggtattttgaagtggcttctggcatgataagccagcgtgcttgctagagagtgtagtagtcatagtaatacttaacactggagtgcttacattatactgctgagcactttatatgaactagctcaccttgcccaccaaggctctactttaacaggcactacagtgatgaagagcatagactttggggccggagtggccagagtgctggttaaatgcccactaccacttactagggtgtgagcttggtcaagttacttaacattgcagagcccgttttcccatctctaaaatagaaatagtggtggcacctgcctcctggggttgttgtgactgggttaacatgtttgtacagtactcagaacaatgcatggcacatagtaaaaattttaagtactaatttaagaagagaagagaaaaacattgtataagtagatctaaggtgttaggagatgtagttatgttgggggaaaaaaatctctctggctataatgattctgtggaggatcctttccagtccttaaaggtggttaaacagttgaactctaacctcctgaagagcctaattttattctttggaactatagaagatgtttggcagattttttgctcagtcgtttttatcatcagaaaggctaaaagtagggacaacttatttccttgggctagggattgaaaaacttagattttgatcccagtcactgggtgagcccacatgcttatttcaacctctgtgctgtctctccctccataaagtaatgggaaggaagatggcttcaaggaaagagccagggtctgagagcagtgattggaaacctggaagaagccattcacaccccatgtgctccattcattcatctctaaaatgcctgtcaatcaaagtcaggcaaattgtgagaaaatgaaactgtatgtagaagtacttcgaaaataaaagtgttttatgttcacagcattattattagaaataatctttgctaccagctcatcataaatgcttggcagattaatgaggtgatttgataattgtaatgttttgagtttctttggaagacgtgtgtaacacaaatgccaggtgtttctgttatgggagaacttgaataagtcacagaggatctaactacatgcttagtacatcatgctgagtattatagaaaaacaaaagaactttaaaacaaggttcttggcttctaagaatatagttttcacagggtgataaaatatacacctagtattattcagtacgacatgtgattgagtgctagaatacgtgatgcagacagaaagtactagaagaagttgtggagggggactatataggtggtaactgcttttcttttcctgaggtaaatgttttctgatggctttgtccatgcaggattcattttctacttctattttcccagtgatttctaatgttcattgagaggttacaaaatggtttatgattatatatgtccaacttgacaaccagaatccatttcttagtctaaaccaaaaaaaaaaaaagctggaagctgatggggataaaaatagaaccttaaatatgatcaagaccaaaatgttttttaacatgctgtctcctgaggtcagcatagaaacattcataatgtttttattctagttctttttcctgacttttttatttaaaaaggaaaaaatttaattgagtgtactcagaacttccataaatttctttcactgtcccaggtaaaatagctgagactattgcagatttctaaatgaagaaatagacctttaacatgtgacagtgatcatagtgctacaacctaggatataattgatcctcccaattttagcccagtctccattctctcaaagtacatgtaagctgcaacacctgagctgtttctaactccctttggttctgtagtcactagtcctgcacctaatattctcctccttcattcctatactttgtcagtaagatactagaagctggaagggggttgataatgggatagtggttacaagaaaaccataatggaattaccctgggagggagcagagacttaaagtatgtcttggttttacctgaatttgtctaggcttccctgaataaaggactttctcatttgttctctagctaggtttgggaatattttcttgacctttatgcttcaaattagccttgcaaattggctcaaaaaatatcttagccttcaaagatgttcttttactttcagaattatggatcattcccatgcttacccatgcctgcagtccctgtcattaagcagtgagaacactagacacatacttggcataatttaatagaaagatcatggaaatcagggggcagaactgattgtatttgatgttggttcaatatttgatttcagaagtacctcctttaaagtccccccgcccccaaggccctgagagtgtaaacatagattaatttgcatcatggtttgaaattgggggggttgtttcatttcagtgctgttgtttgccatcagaactgaaacaccagatagtcactatggatctgcggtacctaggggtttcaaagcattgttttgaaaaaagaaagacacaagtttttgagggttttgtattcaaaactacagaaatgtaagggagaatacatagctaaagagaaaactgcctttctcacctgctcacccttgcctggtccatgctgcttgcgggggaggcttgcatgcttggcaggaagtcctagtcaccctccagctggtgtggcccctgagcctttgtccacaatgggagcatcaccctttcaccctgatggaagtggaggcatggtctagctgcttcgctgagttggctagtgctttcaccttgatcctgttgtgagggtgttttatgtctctgtttttgctcccaactttttttgggtggccttttcctgtagtatgccctggagatgcgagattttcctctggcagcaggaggcacgcacccagagaatgctggagctgcaaggggaaaggacccacttccacagcagagaaaaacaaagaggaaaaaggcatacaggcagcgagcgctaagggacgcacccagcaagcagtgggccagtgccactgcccccagcagctgtttctgctgcaacccgagaggaactcggtgagcctgtcccgtttgtgactgcaagctcaggatttcaatcaatgcattccagtaaccctaaagtgaggagctctccatcaggaaacacacagaggtaagggctgggctggggcctcttcctgcagccccttggggatgccataggcacaccatgaacactcattggtgaaacagtatgttgaattagaaataaatgaaacccaaatgggaaaggaagagaaaatagactagtaaatagtaatataacagtaagcaggatacagtgtaatcaaagcttatgttagagttttcctttgttattcttttgtccatcattccctgacctctccccgcacctccctgccaaagcacaaacgaaaggaccatagagaccaaccagtacagtttgcctaagtttgcaaacaaggaaactgaggcctggaatggtgaggaagcctaatgtcgtagaactaaaacgttattccccggactcccactgtgacactttttcctcggtttcacagtagttaaattgttactttaaaagaattttgtcctcactccctgagggcagtggttggtttatctgctttggtgtaatactgcttgttgggagggattagtatcctggaggatttccctaacctgacagtcaccagctcccgtgctctttgggaccagcttgcattttccagcagggaagtgaggctctcctacagctgttccttgtcatcagcctgggggtgggtagtattttgatcttaacgatgcctgtttgtttactctgagctagtcttagtgtaagagtcacctctctatgtacatagaaaccgttgtcctttattgacagaagccctggagatgggtccccatgtgactgtagggttcctgaaacctggcaggccactctgcttgatcctcctctctgttgatagctctgagatgggatcaggggtggcgggagcaagcaaatggctgaggtgaatcatggggtggttattttagtcctaagggtctccttgacccccaatagaaactgcctctctctaatttgtgctgaccagctgtatctggtgtctgatcttcctttgttatttgtttcttttagtagccctaagtcaaagcaggaggtgatggtccgtccccctacagtgatgtccccatctggaaacccccagctggattccaaattctccaatcagggtaaacaggggggctcagccagccaatcccagccatccccctgtgactccaagagtgggggccatacccctaaagcactccctggcccaggtgggagcatggggctgaagaatggggctggaaatggtgccaagggcaaggggaaaagggagcgaagtatttccgccgactcctttgatcagagagatcctgggactccaaacgatgactctgacattaaaggtatgtctataagatctttgagactcagagggaagtaggtgttcctgagggaaggcctctgacattcgacagaggccagagagcctaatatcagacaagtggggagagtaggtatcagattcatgagttctcacagtttatgatggaactatttcttctcattttgttactaactgaagaattgtttggaacctcctagttgaggagttcttgcccttaaggatgcaacggtttaggggttatggtaggatgtttcacaggcctatccctgttcgtacacgtttctggcctctatgctgtttgtactttagtttcaagccagtagctctagtttgtctgtgccagtggcccccactggggtagtttttctggtatccccttctcttctccatcagagcaatcctccaaggcttgggtcttgtgttctctagttgccattttgccagacttcagacacaagaggaagccttaatggccctggcagtagtccagatttgttacagctgattttagtgtagcaggaatgagtggctaccagatgtgtagagatttggcaggcaccaaaatggagtgagccaagaagggtatgggaccaacagctgtggttttaggctttttcctcctagtataagaccaaaagtcttaactgtaggccagaacatgaagttagtattcaaggaatggaagtatgattttccaacccaaattagaaatggaaacttgggtgattgtttctcccctccttcctcccctcctccctcaagtgttttggcaggcctgctatgagtgccagcactatgctggggggccatggtcagcaagatagatacagctgttgtcctcaaagatttgaatgcacctagaaagctgattattagacagttacagtaaaatatgataaatgctgaaataagagaagttagagggctgtgagatccatccccagttaagtctaggaggtttcaaaaaggttaccagaagaagggacatttacactaatatatgaaggaggtgtaatagagaggtaaggaagctggggaagactgctttatggttagtcatttgagagagaagagtatttgaaattttataagtagaagaggtttcctcttagcaaggtggtacttccttgaaattctcaaggtgggtttgtgttgtgatgctatatatgctggcagaagaaaggaaattttattctttctgtgacgagtcattttattcttttagaatgtaattctgctgaccacataaagtcccaggattcccagcacacaccacactcgatgaccccatcaaatgctacagcccccaggtcttctaccccctcccatggccaaactactgccacagagcccacacctgctcagaagactccagccaaagtggtgtacgtgttttctactgagatggccaataagtaagttgatggctgtgtcttgctgttgggcagggcttgtctggggacctaaattcttattcccattgcagattgatcttttattatcacctaaagttaacagtacagataaaacataaaacctccccaacccaaactcccccagaggcaaccactgataatacatcctttgcttccctttcagaaatttttcgtgcttgtacaaatatacatatatatctctttttcttttttttttttttgagatggtgtctgtctctgtcgcctaggctggagtgcagtggcagatctcggcccactgcaacctccacctcctgggatcaagcaattcatctgcctcagcctcttgattagctgggattacaggaacccgtcactacacccagctaattttttgtattttttagtagagatggggtttcaccatgttggcgaggctggtcttgaactcctggcctcaggtgatctgcctgcctcagcctcccaaaatgatgggattacaggcatgagccaccgcgcctggccatatatacctcttttaaacagaagaagttgattgcacaatacacacttttctgcaacctacctattattattttctaaacaacacaagtaacaaatgtccattctagaataattagaaagtataactaaaaattaatatctctggaattcacagagataactactgtaaacatttttatatataaatttttagtggatggatgcatcaatttttatttatcagaattgtgattataccctacatatatggttttctgactttttttccacttaagataaaaagtgaatcttaacagccttaaactatcactaggtattgtacgatctcatcttcccccttcttgggttgggattttgaactcggattctctataaaacacctaccacagcggattagtttcaggagaaaatcttggtttttgtcttttaatgcctcttttgggatttgctaatggctgtcttttaattttagaagtttgatgataagtggtaaatataaataatgaaacatgtttgtcttgatttcttcttcaacatttctggtggttctttctattccttcctctcccttacaagtttattgtgtggttaaagtgctttggaattacagttagtgaaatagaaacaagttctagtgtgtgctgtctcttccatctttgcagagctgcagaagctgttttgaagggccaggttgaaactatcgtctctttccacatccagaacatttctaacaacaagacagagagaagcacagcgcctctggtatgttgtttcagaaactgagtaatggtttaatgattctacagtgactgcaaaggaaaggaggtggtgaatttaattgataggaaggtagtcttgatggcatgagttgcattcttggcatttaacctaattctggcattgtggggcattaggcatatcatactatactagccttttctacgagaaagctggtagattgatgaattactagggggaagaagatgcaaactaaaagaggagctatacagatatctttgggtttccttcatgtaatcgtctctgggaaaatctaaattcagaccctgtgtacagagcaggtttttaaaaaataacactcttgagctagttgaataacaaagaaagaacagaaaaaaagcaacaattaaaacttctagagtacatgatgacagtatcataatcagagcctcatcgactttcagagtgattcatatttatttcaaagtgataagaccattgaatgtttttaattgcttgatatttgtaaaattgtaataaatgttagtctgttttctatctggatcttaagcacctgctataaactccattagaaaaagcatacagtggccgggcgtggtggctcatgcctgtaatcccagcactttgggaggccgaggcaggcggatcacaaggtcaggagattgagaccatcctggctaacccagtgaaaccccgtctttactaaaaatacaaaaaattagccgggcatgctggcgggtgcctgtagtccaagctacttgggaggctgaggcaggagaatggcctgaacctgggaggcggagcttgcagtgagccgagattgtgccactgcactgcactccagcctgggtgataagagtgagactctgtctcaaaaaaaaaaaagcatacagtggatgttttaatgcatgtagtttaccaaattgaaccaaaagatacttcttgtatctggcatcgtcaagccattgcaccaaatgctatgggggatactaagaagttcaagacacagtccctgctttcagggagcatgaaatctaatactgggatgagtcttaaacatgggaaaagttaattgacaataaatgatcaaagtgacaattcaagataaaataggtgacatctttcctattttgtgtatcagaaaagtctccatctttgtagacataagcagagcttaggccttcctaaacttagaaaaggaatttcacattccccatgcatcttgactactcaagggtagaagatgcatacagttatatttaaaatgcttattgtcctggaatgaatatagtacagtgtaactgaaaccaaccttttattgacttaatggcagttcttaatacctacaccttaatacctacacctacaccttctctggtactaaaatcaggaaaggagttaaggaaggaattgggaataatccattgttccacatctaaatgttttctgacgtcatggtttcgttatatgaaatcagtatccacccacaacaaacaaaacctgaccaacaaaaccaaacttaaaatggcactagaaggaaaatcaaggtgacctctacactccagttaggagtgtggatatgaaatatacttttaactgtacagaatcatacaagatttagctgatcttacgtaaccacacaactcgatacctataggcagaagtgcatggatacctcaaaatccaacatttatatatatattcacagaatataagtgctcaaagatatgttttcatgtgtatacaacacaaattgttcatatgcagagatacacgtaattatttgtttacatatttgcacacaggtaaacattccagagagtaggtgaggaggtaagagcctgaagggtttggaaatacagactggattaagcgaacaagtaggagcaaatgaacacggaaaaaagggtctggagaaaggcctttggtgaaaggtctctgagacagggtttgtagatcaagtccttctgttcatcagtgccctcttatatttcagcagtgctcttggtttagacccagaacatacacatctctcttccaaacattcaaggtgtccatgtcacctattgtaggtgagtgtgcttctaccctggacttagtatagcagtggtacttaataaacaataataaggcaatcatccagcatattaaaaaagggcagtctactgcctattggaaagaacagttcaagagacaccatgagctagatagcctcagatttctccacagaagcttcctgcctgcagattatctcactacagttaatgtacaaattcttatcaaatgtggaatcagtgatcaccaaccaaaaacggaaaccagagatgtcaggcctcctggaaactccaggaggggagtgcctcagtagtcaccctgccagaggagacgttgaaatggagcagctgcttcctcggctggtagaatacagagctgcaagtgacttacgctttctctctcaagatggcaacatcaggccttttgattgacaatgagaagtctacatacccagttatactttcagggaaaagaaaaaggtgttaggtacagcctcccacataccaagaaactaatctctctctgaatcagaaacacatagtagacatgtgatatcaaacctgttcctcaaaatagatactgaaatgtattcactttggcagagtggctctcccctggcatacttttaaagttattgaaacctaatcttcagcaagggaaagaggataccatttgacagtaagtttaaaaaaaaaaaaaatcaaaatgtctccatgcccaaaagagggttgtacgtgagcaatttctacagccagtgtcagttagatttatgtgcctggggacaattcctttataacatatcttgctcttttaattgcccttctgttcagtttactaatgatttttaaactatttgtttgtcttcagaacacacagatatctgcccttcggaatgatccgaaacctctcccacaacagcccccagctccggccaaccaggaccagaattcttcccagaataccagactgcagccaactccacccattccggcaccagcacccaagcctgccgcacccccacgtcccctggaccgggagagtcctggggtagaaaacaaactgattccttctgtaggaagtcctgccagctccactccactgcccccagatggtactgggcccaactcaactcccaacaatagggcagtgacccctgtctcccaggggagcaatagctcttcagcagatcccaaagcccctccgcctccaccagtgtccagtggcgagccccccacactgggagagaatcccgatggcctatctcaggagcagctggagcaccgggagcgctccttacaaactctcagagatatccagcgcatgctttttcctgatgagaaagaattcacaggagcacaaagtgggggaccgcagcagaatcctggggtattagatgggcctcagaaaaaaccagaagggccaatacaggccatgatggcccaatcccaaagcctaggtaagggacctgggccccggacagacgtgggagctccatttggccctcaaggacatagagatgtacccttttctccagatgaaatggttccaccttctatgaactcccagtctgggaccataggacccgaccaccttgaccatatgactcccgagcagatagcgtggctgaaactgcagcaggagttttatgaagagaagaggaggaagcaggaacaagtggttgtccagcagtgttccctccaggacatgatggtccatcagcacgggcctcggggagtggtccgaggacccccccctccataccagatgacccctagtgaaggctgggcacctgggggtacagagccattttctgatggtatcaacatgccacattctctgcccccgaggggcatggctccccaccccaacatgccagggagccagatgcgcctccctggatttgcaggcatgataaactctgaaatggaagggccgaatgtccccaaccctgcatctagaccaggtctttctggagtcagttggccagatgatgtgccaaaaatcccagatggtcgaaattttcctcctggccagggcattttcagcggtcctggccgaggggaacgcttcccaaacccccaaggattgtctgaagagatgtttcagcagcagctggcagagaaacagctgggtctccccccagggatggccatggaaggcatcaggcccagcatggagatgaacaggatgattccaggctcccagcgccacatggagcctgggaataaccccattttccctcgaataccagttgagggccctctgagtccttctaggggtgactttccaaaaggaattcccccacagatgggccctggtcgggaacttgagtttgggatggttcctagtgggatgaagggagatgtcaatctaaatgtcaacatgggatccaactctcagatgatacctcagaagatgagagaggctggggcgggccctgaggagatgctgaaattacgcccaggtggctcagacatgctgcctgctcagcagaagatggtgccactgccatttggtgagcacccccagcaggagtatggcatgggccccagaccattccttcccatgtctcagggtccaggcagcaacagtggcttgcggaatctcagagaaccaattgggcccgaccagaggactaacagccggctcagtcatatgccaccactacctctcaacccttccagtaaccccaccagcctcaacacagctcctccagttcagcgcggcctggggcggaagcccttggatatatctgtggcaggcagccaggtgcattccccaggcattaaccctctgaagtctcccacgatgcaccaagtccagtcaccaatgctgggctcgccctcggggaacctcaagtccccccagactccatcgcagctggcaggcatgctggcgggcccagctgctgctgcttccattaagtccccccctgttttggggtctgctgctgcttcacctgtccacctcaagtctccatcacttcctgccccgtcacctggatggacctcttctccaaaacctccccttcagagtcctgggatccctccaaaccataaagcacccctcaccatggcctccccagccatgctgggaaatgtagagtcaggtcagtatgcttgcatcctcacagttgcacctagtagctggagactgctagacctgatagttactttaagaaaactggtgtcttgagtacacagacagaggaggcagtctttgttgaaatggccatatttgtggcaaggtgcataatcagtgcttccatggggttatgcagaagtgtccaatctcagcaaaaaatacgtatgtcagagagactgttgaagaggggaaatggggaatatgtgttgggttcacagaataatttacattcgcacaatgaacaaatgcaataaaatgtcttaacagtggatgaatgtggcttctttaaatactggacccactgcaaggggctgcccttgaatcgagattctgggtataatcctaagcagagagaggggaagctgctgtaagacttgtgtggttcttgtaaatacctgttgaccacagaaacagttccaaaatcttctccttgatagaccactgttttcacagatcagctacaatttaggaggattttcttcctgggagagattcttgctgatgatgatggttttgtgagtgggactagaggtggtcagtggaagtagtgccaaggtgtaaatactaggttggtgctgtctccacctgagaaagactagaatcagagcaagatagaagatttatcctaccagcctaaagtgcctctctgtagggtagcagttcactgaagcagtacagtggaacagccccctcagaccttcttggttcaaacatcttggttgtggaaattaatcaagaatgcgtgtagggtgatgtcgttagtacctgggatcatatcactagtctggcttcatagcatactaatacctgagtcgaattctaaactgtgattggcaagggaaagagatccacttatttcacattctattcagtgaaatggttgtctgtaaaccatattttccccaagcttgaactaatatttctaacacattcctggtgtgtttgtcttcacatctgctgatcggtcatgtcacctccatatcacaccgcagtctccctctgcactcacacagagcttgactagaagattgatgatttgtgtctgggatctaataacactgtcctgttcatctgtctcattcctggccttgctagttcataatcatagggcccaatacccttcaaaaggaatctaattccctgcccgttttgttttattttgcttccttttaggtggccccccacctcctacagccagccagcctgcctctgtgaatatccctggaagtcttccctctagtacaccttataccatgcctccagagccaaccctttcccagaacccactctctattatgatgtctcgaatgtccaagtttgcaatgcccagttccaccccgttataccatgatgctatcaagactgtggccagctcagatgacgactcccctccagctcgttctcccaacttgccatcaatgaataatatgccaggtaagaaatcagaaaggcaggttgtggagtgagtgctagaccaaagagaaacctcttgaagcgttttctcaatggctatacacctgaataggtggaagttcaacaagtagaaaaaatcttccatctaaggtagtttcagtagaatgaaagtgtcttgactagaggaagataatttcttattagcttgattccttatttgtttgtaagaaagcaggtttctttatagttctgatgcttctgtgtacctggatggttttgagggtttgttgtttttgtttttctctttgggtcctcatgtagcaatatagagagtagtttctaacaggctgattggaatgtctttagtcctcaagtttttttttctggaagagcagcctcaaaccacaagcagccacaggatttcagacagtggaaagcccctgtttcctagacaagccttttttttttttaggactagggagataataaaatccttcccttccctacacattcggtacaccttcattcctatacccacccctcacctcgactcctgccacctgactaacagaaaatgatcaggatggtgaaagcaatcagcaaagagaccatgacttttcagccatgagtttctggttccagttctattctgattgttacaaatgctctttatttatcagtaactctaattaactgggttagtacatgtaccaggaacagcataagccccctgccacactcggtggtaattccacagagacaccaaatacttcaatgtcccagggactgtattagaatatgttactttccttttctattaaaagttatttcttgaacatttcgtggaatctcgagttttaaatgctttctctataaggcacttataaaataatgccaaatgccaattgaaaaattacctgtttagtttctttgttatgattcctgatcattgggattgtagtactgatttctccaaaaggaccgtacttgagtcattcaggcaaattgttttcttctgtattaaatatctccaatgaggaaggcgaaactcatttgtgtgctaatttataacttttcacacatgacaatttctcccttgctatcttctacacacagtttaagactcaataatatattgtcctgtagagctcttggtttgtatgtccccagatgtattatgatcttattgatggcagggattgtgtgttgtatgttttcccagcattatactatgcacattggatgcacaatagtttttttgttaatttattatagtttttctgagttgatttttggttaagttgattcctttgatatctttatttttctaggaatgggcattaatacacagaatcctcgaatttcaggtccaaaccccgtggttccgatgccaaccctcagcccaatgggaatgacccagccactttctcactccaatcagatgccctctccaaatgccgtgggacccaacatacctcctcatggggtcccaatggggcctggcttgatgtcacacaatcctatcatggggcatgggtcccaggagccaccgatggtacctcaaggacggatgggcttcccccagggcttccctccagtacagtctcccccacagcaggttccattccctcacaatggccccagtggggggcagggcagcttcccaggagggatgggtttcccaggagaaggcccccttggccgccccagcaacctgccccaaagttcagcagatgcagcactttgcaagcctggaggccccgggggtcctgactccttcactgtcctggggaacagcatgccttcggtgtttacagacccagatctgcaggaggtcatccgacctggagccaccggaatacctgagtttgatctatcccgcattattccatctgagaagcccagccagacgctgcaatatttccctcgaggggaagttccaggccgtaaacagccccagggtcctggacctgggttttcacacatgcaggggatgatgggcgaacaagcccccagaatgggactagcattacctggcatgggaggtccagggccagtgggaactccggacatccctcttggtacagctccatccatgccaggccacaaccccatgagaccaccagcctttctccaacaaggcatgatgggacctcaccatcggatgatgtcaccagcacaatctacaatgcccggccagcccaccctgatgagcaatccagctgctgccgtgggcatgattcctggcaaggatcgggggcctgccgggctctacacccaccctgggcctgtgggctctccaggcatgatgatgtccatgcagggcatgatgggaccccaacagaacatcatgatccccccacagatgaggccccggggcatggctgctgacgtgggcatgggtggatttagccaaggacctggcaacccaggaaacatgatgttttaagctgctaagatgggatgtgccgatccttgtcaaaatgagattccaggtcctgagagctgctttgaggcagttccaggagtacttactattggtcatgcaataggagaacagagacccgagggctgctttgggggaggggggaactcgagaatgtatggatttacctgaaaacaaattattcatttaatcaacaggtgtgttttttttaagatttattttttaaaaattatttttgtggacttgggtatcaatgatggcacctacttttgggaatctgtagctgtgctttgagaattgccatcggtcatgtgttgcaccgttctctgtatgtttacgtcctttggactggcttctcccaggattcttttctgtttttgtttttttgatttgggctttatttttttctgtgtactgtactatattgtaaaagggattttagcagagactttagtctttggggcaagaggagaacaggaatgctgggctgtttactttaggtggagaatccatcttcagacctttggactattttctttcaactgcagtgtatagaaaaaccaaactacgacctcagagcagagtattaatgaaaagcacaaaaaaaggaactaagttcagcgaggggtggggggaggggggagatttttcttttgaaaaataatgactcttaggacatttgtttttcagttcaagtgctcttcagcactgtcttgtctcccaatataccaacccactggcacatttttctcttgttttctctctccgattttgctctgtctcctcagttaagtgtttccttcctttgtgccccccgctggtgaccctctgcttccctctctctttccctttggcagctgcaatacacagtgttattctggggaaataaatctagcaaagcctcgccttccatgccgagcgtcctcttggctctgagagggaaaggtctgtccttgggatgctctctggtcttttttccccctaagtctttctctttcccatcatacccttccctgcccaccttgttttctgttctccttttattaggaattcccaagtgaattttattaatgtgggagtggaacagatgctaaaagctatccaggattttgtttctgtttgttttaaattttgtggttccttccctttcctccccctcccatgcgtaagacgttctgtgtaacctccattaaatttggtacaaaaccactcgccagagctgtggtgtcagaaaaataaaatatattgtttcttacaaaattgaactgccttttttgttcatttggattcctgattgtttagtattgggcataccggttgccatgtgacccagaagcgtagactctttgtattggagttgatcagtaaggtgatggttagggaaaccacataaaagtaccttctcaaagcatattccatgctgttaaggaataactactcatgtaggtttattctgtactgttcctatctcagtcatgaaatcctagttataagcagaagagcaaccctggtcccattgctgaactttacctttagggcaattaatggtctttattaggaatgtttgtgagagccagtttagtggtatgaagtaattaagaaggccaaaggttgtatgtttagttatttgaataagctatgagatgtcccttggtcttgttaaggtagaatattattactatacctgcaaattatgggtttccacagtccgtgggtttctgtggtcctttctggctccccacctcccccttaccccatcacctctgctaacgctgctcagtctttgtgcacagttcacttctcaccacacacatcttcagcagatcagtgtgtatcctgcaaggtatgtgctaatggacttgctgttgtgcttctgtgcagttaattctgttctggtgtgtgtatttctttgagttgtaggtgtttttagctcagtgagtgggcgtctgtgtgcgtgtttgttcttaggtgagagaatctaagcgaggagcggcaggtgcagagtcatctgcaaacaaacttgtacaaattgggctctgctggtgtttcacagtctgagcttttctctccgacaattgttttggagagccattttctcttccttttcagcagccctgtcttcttagtaacacaagtgccccagacaacaaaaaatgtggagatgaacatttgagtacctactctaccagtcgcctccctgcactttatcttgctgatttttaaggggccctgtgaagtgagtggtaatgatctcatttgcagatgagaaaacttgagctcacaagtttaagaattctgattcaatctgatgtattctgttggtgctgggtagtgaaactttcatgttgtagagaaattaggatagtaaaatgaagattttgtttcacgaacttagccatgtttctgggttctctggctttaaagtatatagatgagaacagactaacagccaagcatgggcagcacaagatgagaacctgaaggaagggtcccacctggcatttgtctactggtctggcttcttgggttgctcccctccttgctgtacccaacagtgttgcagtcactaatggtgtgtggtcctgttgttactctcacaggcagggagtcaaggcataaaaggtacccacataggagagcaggtactcacttagagggctagcaagagaccggtgggtctggctgctgtgggcagctggatgtgtggcactcctctcgcagccccctgctggagaacttggggcagtgcagatcaacttccccacctgagtttttaaaataccccatcatacaacttcattcactttatcagcacatgccatttcatcacgataatgtctgacaagccaaatttagggtctaaatacaacaatttatcatttactaagattgttataaaataaaattacctttagagagactggatgctactgcatggagaactgatgcaagattttttaaaaatcagtggaagagtgatgaaagatgtttcatattaacatattcctgtgaaagcccagccaatcttctctctttcctctcctgaagtttgggactgaatggagaaaatgcagtagtgacttgttcacttcaggggaaagtggtggagtgtgtgtggctcatagcatttgttaaggactaactagaagtatgtagcattttccctgaaacaatgtaaaataaaataatttactttagaaacgattctgcacttatacatgaaaacagacataattataggggtcttatgaaggaggcggcatgagaaaataaattgaaaacaattttacatatttaaagctactccttaaaaaatggatccaacatttctcccagcctccctgcgctctatacttcttgatattatcatcacaacgcaactgtggtcatctgtgccacctgtgcagttggacaggactccggcttggtttaatgctccgctgtcactgtttggagttcttaattattgaataggggctccacatttccatttcgccctgggtcccacagattgcttagccaggctgttgtaaacagaaatcacaacagctccacagaggtgctgggacctcagtctccatatttattctttctccttaactagtggccaggagcacctcaggcagggtacttgctgtgttccgcttaaactgtctacacttcagtcatttccttttccttttctgagtaatttcagggtgctgaaaggagagggaagttgcattttaacccgaggactcattatttagcaaatatttatagagcacctactgtgtatcaagaactgtgcaaaggctgggatgtggaaacaggtgtgtaaaccagttattgcgatgtaatatgatgattgctacagtgaaggtgtggacagggcgcaatgggccagaaaggaaaattcaatgaatcctcaaaggaaaggtgattttttgaactgactcttaaaggagagagcattcctggaggatggtggtgagcactgaagcagaggaaatgggaacagcaagggcttgctgatgggatggcctctttaagggaggaagaagtaaagaagtaagaaataagcctaggccgggcgcggtggctcacgcctgtaatcccagcactttgggaggccgaggtgggcggatcatgaggtcaggagatcgagaccatcctggctaacatagtgaaaccccatctctactaaaaatacaaaaaattagccaggcgtagtggcgggcgcctgtagtcccagctactcgggaggctgaggcaggagaatggcgtgaacctgggaggcggagcttgcagtgagccgagatcgcgccactgcactccagcctgggcgacagagcgagactccgtctcaaaaaaaaagaaaagaaataagcctagagagagagtggatcacagagagcccagtgtggcccactaaagagtttgaacttcaaagttttaagcaaaggatcaggtgatcagattgtggaagatagcctgggggcggggtgagagaaccacaggaagatcacttgcaaaaatttgcttattctacaaaatcctcagactcatctcttttgcttgaaataacattaaattgtatcatatttcccatgctgtttaggcaacttgagcctcactgccactttcttttctctaactcagacctgtaatttttttcaaagtcacaaacccttacatttaagaaaagtcatggaatcctaatttggtggtaagattttaataacacatttaaagcaataagtatataaagcacaaaaccagtgggtggccaaacatttcctattggagggagctaaatcataaaaataatgttaaaaggaaggtatgctataaggattgtaataaaagttgtctctatttaacatggcttcttatttgggttactgttaaacagacacgaatctattttctgcctataggtgaccccacttcagctgttaactttctgtctcagtgcttaattgtgcttggtaatcaatactgtcagaggaagacggtgagtgtatgtatgaccatagaaagagaaaataaacagaagaaccagaaattatttcctcacacatagttaaagcatgggaaaattcagttatttcaccaaacacgaaagaaaccagatttctcttgcaaaatacctgcttagtgtccacgaacaattatgtgggtaccctggggttccaaagaacaggttaaagagacccagccctaggaaactgcatgtcttcaccggggccagctgggcgtgttgctgtgtggctctgggcggctgggtttctcatacctcagcacctgcacctagaccagcaactccctctcatgaggggctgacccgcagctctgtgctagccacactcttccattctccagaggctggagccagggtcaagggcagaaacagcttataaatctcagttatatccagtgtccaattaattagtgttgagggtgaatttagttttcaataatctttttgttttctacagccgaagttctctttattaaagaccccaggagctcatgtttgtttctcatctttaccaagcttccaggagctttcattttcctcacttcccacatagaagctcaacagctaccccatgagctgttttccctggagactcctgcccatccccatgaatcaatctgtgatctaaggccacgcttttggcggtgctttacgggctctggagtactggcttctggctgctcggttctcagcgtcaaatgaagacaagggctgcgtctggcaccttgctagaaactgagtcattgttattgggttcagtcaaaatgtatttgattacaggggatggtggattactgtgatttattttgttctccaaactgcagaagatctcctgggctttggtaaaattctctaggatagctgtgagtagtcgagctattgaaaacttttatacacacatatacacatacagatttacttatacacatgtatatgtaccttaatatatgaaagtatgtaaataattaaatgccagttttgaaatgtcaacactgcaatgaagagtagtttgctttttccttgtcaatgaggctggaaaagccctagaattttcttcattcctgttatgcttggtacctgcaagtcctttaaaataaaatcatcattatttaaaagtgtgataataccaatgaggaaatacaaggatcacttccatacaaaggaagaaccaggcccaggagagaaattatctgacaggcacctcaaacttaacatgtcttaaacttaacctctgaatttctctcacatcttatctccataccccacttccccatcacagtaaatgacattatatccatcccctagttttcatatcagacacctgggactcattcctaattctttactcctcatgtaaaaccatcagcaaatcctttcatgccaatttccaaaacatatcttaaatccatgcacttttcttcatcactctagatgaagttactatctttcacctcatttattacgtgtttgtttgttttttaaccagtattttcactctagctcttcagtctattctccacaatataaacaaagtaaccttaaaaagtatgaattggctggacactgtggctcacgcctgtaatccctgcactttgggaggccgaggtgggtgggtcacaaggtcaagagatcgagaccatcctggccaacatggtgaaaccccgtctctactaaaaatacaaaaattagcggggcttggtggcacacaccggcagtcccagctactcaggaggctaaggcaggagaatcgcttgaacccaggaggcggaggctgcagtgagctgagatcgtgccactgcactccagcctgggcgacagagtgagactctgtcttaaaacaacaacaacaacaaaaaaaacagtatgaatcacaccactttcttccttaagaccctttcatggcttcctaatgtaattagtatgaaacccaagatttttggcaggactgccaggccccagcgcctctccagttttgcttcatgcccttcccccacccactgtgctccagccgaaccatgctaatttcagtatctccagcgtgccaaggccttcttgccacaggaccttacccacaccagttctttggcctggcatacttgactccaggctttcccaatggctggcttctccatgcccctcaggtctcagcttatttgtcatctcctcagagaggtcttctctgagtaccctgtcaaatacctacctatgcccaacacacacacacacacacacacacacaccatcattttgtatcacgactctgtttgtatccttcatagcaattatgtattttatcttgcccactgtgtgaagtcaggagccaaatttttcttgctcatcacttgttcaccagcatctggcatagtgtctgcactctatcaaagatcagtaaatagctgttaaataaatgagagggaagaaggatccatatgagcttgggtggccaggaaagatttcatgctggttgtggtacatgaggtggaccctataatgaggctgggggtggaggacacacagagaacaacacgaatgaggaaatggcagtgggaatggacggataaagaaaagcaggccaaatgacagcgaagggaacagcttaaacaaaattgatcatgtgcacaatagaatgtgaaattgaaaagggagggaagaatgaatagccccaaaagccaagaaaaggaatttcatcttgatatgggaaacaattgggacccactctttggtcttaatcagaggacttacatgctaagtgttttatcaagtgagtctggcaggggcaagcaggatggattgaagcaaggacaggctggaagagctgactggaagcacgcacctattctggggttgaggaggtgaggctcctggcgattcagtggagagtaaagggtgaagcaaagacagctgtgaaggaagaacccccaagacttcattggataatggggacaatcactggagaagaggtaggaatcaaacacgatgtggtgattttgagactgagaagctgaaagaaaggtagaatcgtggtgttggaaggggccatcctactgccctaagtatccctgacaggtggccagcacctccacttgagccgtccgataatgggagcccattctattgaacatcattagctctaatatttagaaaattctgccgcctaatgaatcaggcttcttttagttttttgcccattcatcccaattctgactgtaggagtaaatacagaataagagcagtccttctttctcatcccagcccttcagatagttgaaaacagttattacttccctcctaattttctttttcccaagctaaatgccctggtccatcaattaagaccaatgagatcaggttttgagttccctaactgccctcatagttttatcttgttttatcacagtttacacataccttgaaagaagaaataaagtgtttggtgccccagtactatctgatcagcagagagcacagtgagactattactttcttttatctgagcacaatttcactaataggcaaaagtttctttttttttttttttaactgctatggagttatattggaattttaggaaatgaaaaccccaagatctttttcatgtaaaaaaagtcatcactcctaatcctgtgtattattttgcttatttttatcctatattcagaattctagttattcctatttaatttcaatattcattctgatctgttgttccacagtctgaaagtccttagaaacttattctaacaatctttatattggttctaacttttctatcaaaagcaaagctggtaatattttcatcaaagtgatacaagaacccaggataaaaacctggagctcataactgaggtgcttttttcacccatttaaaaaaattgtggtaaaaaatacagcaaaaaattgaccattttaaccatttttaagtatacattaatgtgttatggctttaagtacattcacattgttgtgcaatcataatcgccatccatctccacaactttttcatcatgtaaaattctaactttgtacccattaaacaataaccccatttctccctctgaagtttctgaggaattgccatactgttgtccacaagtgctgcaccattttgcattcccactaagaatgtacaagggttccaatttctctagattcttatcaacatttattatttttgtttgttttctcattgtggttttggtttgcatttctctgatgagtgacgttgagcatcttttcatgtgcttactggccatttgtgtatcctccatggagaaatgtgtattcaagtccttggcccgttttttgatgaggatttttggtggtggttgtgttgtaggagttctttaaatcttctggatattaattcctcatcagataaatgattttcaaatattttctcccattccatggggtgccttttcactctgttgattgtgtcctttgatgcctaaaagtttttttttttttaattttgataaaatccaacttatctatattttctttccttgcctgggcttttggtatcatatccaagaaatcactgtgaaatataatgtcataaagcttttcccctgtgttgtcttctaagattttatagttagagctaatctttagagtgacatcaattcagaaatttttaaatgttttaaatatacttgtgtaatcacttataattctacctcttatcatccagctcacattctccatctacctattgagtaattggctctttgattgattcatcagtctctacaaggctaggaactgtggatgcagcagtgaactggtcaggagtggtcccaccctgagctcatcaaacccagagtctattgaagaagtcaaacactgaataagcaattataagcacagtcatggcatgaaagaaaaggaagctgcccacattgaagacagggaagtgcaacctaaaatattttatcaaatttcctgagaatcttctatctactggtctgttaacccaaaggagaaaggaaatagttcagccaagtactaataatgattgctgctttctttcctaagtgctccacagacttttcctttgtttaaaagtccactctagaccaaggagctctccagtccttaaattctggagtctatcattttatgggttttaaaaactagggccacatttgcctttgtattttggttctttgagactagaaatctgagagtatcttcatttctcatagattactgtctgaagtgacatctataacttaactttttatctactccagggtattacctaccaaataggaagatccgaactcattgacatcaaccaggtgctgtcctcactgctctaagatttcaatccctcccagcaatcttgggccatttgtggcttaaaggtagattctgttgttaggaaagacttactaggaaagagagggatttggatttaactgctttcattttctctctctcctctattaaatcttctcccccagacgctgagcctatcttttacttcttcattactttttttctcagaatacagcttaagagcccttagcttcctcttcctgtcccaatcttgcccaagcttctagtattatcatgagtaaaaattagggaagttggggagaagtccttgttggggttgagggagtgttgagtatgaaatgatgaagtggtgtctatgtgtggacagttggaaataagagacagggatgaatgagcagtttggactagatatggagatgtgaattcctccacatggagatgaatatagattatttctctatgggagtgagagaatagagagccaagtggagggccaagaactcagtcatgagggattggcacagtccgcaggcaggaagaagttccagcaaaagaaactgaaattcacagaataggaagaaaacagaaatgatctagcccacctctcccatctaactgatgaggaaatggttgtccagataaaaatgaatcagtgactaaggcagctatgaaaatatagagttgcataagtcctgaggggttgggggagtggctttcaagaaataggaggtggtccacagggccaaatacttctgatcaatcaaaaaaggtgaggaaactaacgatggtacttgaaattgattaatgtattggtctcccagagtgtagctatggtaaagcagaagaaagagaaacctaagcatgtgggggaaagggtgtaagtgtgaaagaggcaaagagatactgagttatacatgctcagtacgtttggcagtaccaggcaagagaaataggatggttagatagaagaaaaatataaataagcaaagtttaagacaacagaagtatactaatttaagacagaaaggaaggaaccaattgagtgggaaggattgaggacacaaaagaagtcctgccatctttggcaggaagatcacaagaagcgggacaggaactgaagcacaggtagcggtaagctttggggaaagaaagataccagaagtgaaaggagaaaggtgccatgtgtgatgaagcagataaagcaaagagacaaagggacacatcccggaagccagatgtgcagatatggaaggaaaacatgctgatcctcaggtcaaaggtgaaagtttgagtcctgcctctgcctctccctggatatttgactttgatctctttgagctggctgcttcacatttggatgtcataggctttttgtgaaactgttatcagacaacatgtgtgtatgcctagtatgagttatcagagcatttttgagagatgccttaggctgtaatgcaaaaagatatgaaatggctgctctggtaaattagaaagctcacaagatacaccagctgggcagtaagagggttctagctgaagcagaaaatcatgattcttctttcagaagggacacccagggacccctcttgctgccctcctgggcactgaaaggtagcacagaaaagccatagagaaagaagcaccacagtggaaattccatgatgggatggtggtggccacagcaggaaggcattttcaagagctactggagtccccaggcccagccagcccaaggtggggataacagcaacactttaataaggttacactggggtcaccagattctcaagcacttctctcctcctgcttttaaagttcagaatcatctaattagaggaccaaactccatccctgaccacatgaaaagcaaaatgaggcctgactctgactcaaactgttcacagagaatgaaggatgctgtggaatcctagaacttcagattctcatggtaggcagggactggcccgtgtgtgaccctctacaatactttgcctaatgccagtgtaagcttataaaagaaccctctaaggtagcccaattcatccatggtcagctctgattatttcaaaggttttccttatgttgatctcaagtctatacatccctgcaacttacacaatactgttctgcgtgtggtcctcagtgcccacataaatcaaatatttgatatgccctctgtctctttgatcccttcctcttgatggtctttctccaattgacaagcttgtctagctctgctaccaagtctggctctcagatctgagaacagttccctggctgtgctctgaactgtgcaggatggaacatcacttccttcattccagtaccaggatagccattgcacatttaggattttgaggaacacatcatactatggattcacactgaacaaatccctcactaaaacccctcttcagttgtgggcaactgattttgaggccccaagatcagaactctgcatttgtctccattaagttccatcttaaaatatttggcctaggatctaaaactgatatcagcacaaacatatctaagacatctatcatttattcattcattcaattagtcatccagtaagtgattttccccagttgtatgtcttcagtaaatgtggccagtctgcaccctgtatctttactcagttgtattttatgcaaatctttgaaaaaaacgtgtccaacagggcaaaggcctatcatacaacatggaacacttccctgaagaacagctgaccactgaattagtttctttattaattcagcaaattcattcagtaagtacaaattgagtccctactacatgccaggttatgatctacagatagcatccagcatgttcactgcatacagcagtgaaccaaccagacaaggttcctgctttttgcagagaaggttacaagggataataaacacttaaaaacaaataatcgctaatattgtttagcttgcctatgtgccagccattgttctaaatgctttatgtgtttattcctcacaaagccttatgaggtaaatactcttcttgttcccattttatagattaaaatgcagagaagttgtcacttgctcaaggtcatatggatcctaaaggatggagcatcaacctgggtagtctatctgtagagcctgtgtgtttaaccactgggcttctactgtgtctctgtagaaataaacactcaattaaatatatatgtatatacatatattcccatgtgagagagggtgatatttaagctgagatctaaaatgacaagaggcagccaactccttgagatctagcgggagagcaaaagggagtgtggtggaggatgaggctggagaggtgggcagggggcctattccatgaggccttgtataccagggattggggctccagtaatttaaccagtggtgaacatgcctagttgcttcagtatccagcccatacatacccatcttgtccacaaatatactgcgaacaatttcctttcctgatccccatacatgatcaaaggacattccctttatactccaaaccattaccttccagtcttcaccatcagtgtggcacagaaaaatacactggtttttgcttttgtttttgtttttttgagacagagtcttgctctgtcacccaggctagagtgcagtggcacgaacacgggccaccacagccttgacttcccacgcccaagtgatcctcccacctcagcctcatgagtagctgagactacaggcacttgccaccacgtaaagctgaattttaaattttttgtagagatgaggttttgccatgttgctcaggctagcctcgaacccctgggctcaagcgatcctctgacctcagcctctcagagtgctaggattacaggtgtgagccacctggccaagatgtacaatcgcagttcagaatccattaaatctccatggtgctatatgaccttggccaagccacaggctctctgatcttcagtttccagggatatttccccattgttccataatgttaccttactcctagaactgaacccctgaggtattcagcattttggaatttttgacctagagaacaaccattccttcaacctttccccttcctgatctcttccattcttctctgtgcaaggcccaggtaagctgtgcctacctttatgcagctggcttcagttactaacagctccagggactgctctctcatctcccaaaagccctgctggtttgaccccatcaagttctacttacccaagtgttatacaaccctccccttaattacacactcaatcagttcctcccaagctcagcaatttgtggtctctgggcatcccccagctgcttttccggaggtagctcccaggctgggtcctggcaagcctctgaagcactgcttgggtttttaaggccatggtacccagagttgaaagccttgctgttatttcacactctatttccttccaaattaattctctgatgaatactgtcctttgcagtgattcagtgcaggccatttccttacatctttcccctacctttgagacttttaatctctctcaaatccagattttcctttgtgaaaggcttgcctcagagaaaaatgccctgctttcctaccaatataaacagctctaccaacactggccccagcctcccggcacactccctttactgcttgacttagctattcctttgatttcaaagcacacatacttgccttctctaaaaatctctgtacaacacagagcaactcaaacttcttggcttacagtaagccgctggaccctagtttccttaagccccaaatacaagaagatgcaggttcaaaacttgtatctgaggaggtagcaccttccataccctttcacatggttattttgcttacatccccctcccctaaccccagcagatagtatcaccatccttccatgtggataaacagaaactctgccatgctaaaggagttgcccaaggtcacagggcccaggaaagtggtaaaactggaatccaaatccctggctcttatctccaaggtaggtgcttctttcagcatccttcatgtggcttaaacacccctgaaacagcctagtcttcagccaccaagatcttaccacccaggggcaagccatctaggtccgcaggcacccactgcccacagccctgaggaatgctccggaggagccacaaagaggctcctctggcatagcaggagcaatggcttatatttgtataacacttttcatattaggaagtgctttccatacctaatctatgtcattcctaggataattccatgagggagatgctatattagagtcccattgcacaaataaagatatacaggcttatcaacaggaaattaatggacttgcccaaagtcacacaggtagtaggtacagggcaggacttgaactcagagcacatgactccaagatcagtggtctcttgagttctcagacatggtgactgtgggccactgcccccctcccaatttcttcaggaaaaggtacattttatttaaaggccaaacggagagcggaatcctgagaagaccagctttttactggggaaagtgtttttcagttctccccagccagccttagacaggggtcaggtttctagaggctggcagggtggactgggaagggccgggctgcaaagtccccttggccactagagggcagggtctgaagagagcacacagccatctccccggggaattccccacccagcagaagagactcatcgctgcctagcagccccaggacacgctctagcccaaagccgaagaatgatcccttcctggcatgttgtagacagggtaggtgcccttagcccacccctccccccacagcccgcccagcctcctctgcaggtagatggcggtgccctagaggattccagctgaggaaaaggggtgccaggtgccactgacaaagacctgagtttcctacaatgaaaataaacaggtcagcactccaggtcccggtgcttcgaggactaggggagggtgggacgggaactctctcctcctccctcttcagttgggcccttcagggtttctgtccccttgctgcagtttttaacgatccacgtggaactaactgttacaggggaataggcacatggcagtgaagggtcttgtctaatgacagtccttcatcccagggcctgccagagccaagagctctgtaagataagccacgaggccctcgggaagagctatcaggggagccgcagatgaagtcggccttccctggcaagcctggctctcctccgtcctgggaagcctttcactttgccatacacgggtgagagcctcctgtgggaattctttaaacctcaacagcactctgaggccccttagagaaaggagtcaaggcagggacaggttaggaatttatgaagagcttttcacaccctattttccatcctcaggacaaatcatcaggtagataaacattaacttccccgctttatagttgggaaaatggaagctcagagaaattaagtgacatgcccacagtcacacaactggtgagtgagggagccagggttctgtacaaatctcctgcacacagaggcacagtgccccgggaagggcaggcggaggcggggcgctgcctgcagaggagcatccccaaaggctcccttggcttgcgaaacctaccacagttaagaatctcgtgggaagtgagatgaaagagaaaagggaaaataagaatacttgaaggcacttatacgtttccttaattgattctcacaacaaccctaattagtacgtatcattatgcccatttttacatgagaggaaaaacaggctcagaaacacccgtccaagcgttgcaaggaaataaatacgctgtcagaatttgaacccagcgaaagccttggtgttttcctttactccatgcttccccctggtggtgagtggaaggagagtgcatagaagccacctgggtgccaacagaagagttaagtcagcgttctgaactcatttattcattcggtaaatctttgctgaggtccactttgtacagtctctgcacttggttctagaaatacaataaaagacaagacaaacaaccttctattgaaggacaaacagaaacacgggaggcctagagataattggattacacaggaaaagggagtgtgggtcaggggtcaggtgatggaaaaatgtgtgccaaggtaaagaggccagaggagtgcgatttcctttttttttaaaacatactataggtctggctagggagatatgtgaggggtgaagctggagaggtatgcaggggccaggtctcagggggtgatggaaagcaagtgagggtatggcccattaggaagccactgtggtaacctaggagggtggccttgggccccggagagaagtgacagaggggatatgtcattcaaatgtccaagtgtctgagcactggcatgcactaggcactattccaggtgctggggacacatcagtgaacaagaggaaatctgccttcatggagcttccattttagtcagggaaataagcatatagatacacaaatatgtaatatccggcactgataaatatcacagggcgggggaaagacaagacaagtgtattcatttgctagggcctgccgtagcaaagtatcacagactaggtggcttaaacaacagaaatttatttcctcacagtgctagaggctagaagtccaagatcgtggtgtcagcagcattggtttcttctgaggcctctctccttgacttgcagatagtcatcttccctctgtgtctgtgtcctcatttcctcttcttataaggattccagtcatattggattacagcctacccatatgacctcatttactttacctcttaaaaggccctatctccaaatacattacacctgaggtacattcagtcctcaacatcattgataggttcttggaaactgtagctttaagtaaaacaacatattagagaaccaactgttttgctcatcagtgttacaaggcaacgatgttgaacaaaacacaatgttattcaaggacctgctatatgtcctttcactgaaagccgacatttccaagagcctattgatagcatcaagtgaggacttactgtactaggggttaagatgtcaacatatggatttaggggggacacaattcagcccatgacagaaggtggcagagtatacctaaggcaggaggtagaaggagggcaaggagggcctctctgagatgacaatgagctgagatctgaatgaaaagagggagctagccacgcaaatgtctaggagagcattccaggcacaggaacaacaggtgctcaccccgaggtgaggacatggctcaggactacttggcatactccatcttcaacgatagtaagaatgggatgggatgatgggaaaaagggagatgttagtcaaaatgtacaaagtttcagttaaacagtagaaataagtttttgtgatctagtgcacagcatggtgaccatagttcataacagtatactgttgtcttagtccattttgtgttgctataacagaataccacagatggggtaatttgtaatgaacagaaatttattatctcacagttctggaagctgagaagtccaagatcaaggcaccagaaggttagggcctggtctctctgcttcaaagatggtgcctgttgctgcatcctccagagaggaggaacactttgtcatcatatggcagaaaagcaaaagagaaggaacccattcctgcaagccctttttataatggcattaatccattaaacatccccattaggctccacctcccagtaacattgtactgggcactaagtgtcaacatcaaatttagagaagacaaaagcactcaaaccacagcgactgtacacctgaaaactactaaagagtatatctgaaacattttcaccacaagaaagtgatgagtagatgaagtgatgaatatgttaattagcttgatttaatcattccctcatgcatacatatatcaaaacatcacattgtactccataaatatacgcaattattatctgtcaactaaaaagaaagtaaaaagtttttattacaaaaaagaagaagaatggtaagatggcgagtatggctggggtgcagtgagatgtcataggaccgtgagggcattatgactggcccttagtttgagatgagaaaccaatggggaatttagagcagaagagtggcacgatcttactttgttttaaaagcaacactgtgttgagaatagatgggcagagaagggaagggcagaaacaggaagactagttacgaggcctttacaataatccaggtaaaagatgacactgggactaagacagtagcaatggaagtattgggacatggtcaattctggatatagtttgaagagagatacaacaggagttactgatgtagtagaggtaggatatgagaaaaagaggggagtcaagggcagttctaaagttcttggccaaagcaacagggtgaatggtggtgtcatttacctagatgggaaagcctgtggaaggagtaagtttgaaaaggcacggaaattgagagtttattgtggacaatgggaagtttgatacctattgtatatcttaaacatccaaatagagacattgattagactgttggaaatgagactgggattcacagggaaaggtctaggttgaaggtataaatttaggagacattgtgtaaatatttaaaactggaaattctttttttttttttttgagatgttatttctctcttgttgcccaggctggagtgcaatggcacgatcttggctcagcacaacctctgcctcctaggttgaagtgattctcctgcctcagcctcccaagtagctgggattacaggcacattgtactccataaatagacacatacagccttccgagtagctgggattacatcacattgtactccataaatataataattttataaaattataataattttataaaaatataataatttttgtatttttagtagaggcaggtttagtggagacagggttttgccatgttggccaggctggtctcgaactcctggcctcaggtgatctgcctgccttggcctcccaaagtgctgggattacaggcgtgagccaccgcgcccggcctcaaactggaaattcttgagatcacctagtgggtgagtgtaggggaaaaggtggaaaaaaggtccaaggagtaagccctgggacaccccaacacttacggattagaaaaaggtagattcagcaggaacaaagtcgagaaattggaggaaaaccaagaaagcatttgtcgaagccagtgaaggaaatagtctaggaatactgatgagaagcttagtaagaagaatgaaaactggctattggattcaccacacaaaggctattgatgattttgacaagagcagtttccatggagtggtgggggtgaatacttaattgtagctggttcatgagagaactggaagggaagaattagaggtagcaactcttttgaggagttctgctatgaaggggagaaggaaaagagaacagcagttcaaagatgcagagaaaaaagtttaagagattttacagcatatttgtattgctaatagaataattggtcaggaaaaaaattgacaatccagaaaaaagacactaggagtcaatgtaaagctagagggttgggctttgataggaatagtgttggttcattcttagtaagagggaggaaggaaggctataaaagcaccaatgcaactgggttagcagatttggtggttgggtgttgggggatgtggaagttttcttctgatctcttttagattcttagtaaaataggaaatacagtaaccagcagactgaggatgggaaggggatgctgaagattgaggataaagatatgtgaatagattaaagaaataaacaggtagtattgataaaacttaactgattagacataggaaaatgtgagacaaagaaaacaaagacagatttctgatttggcaactgggtggagagtggaggtgtctttcattcagatagggaagtgtgtgggagaagcaggtctgggaggaggggggtttgattctaacatggaaagttttgtgccagtgaaatccaagtggataaaagcgtctgaagctcagaagagaaacctgagcttgagatatctcagctccctgatctggaagttgtcaatattaagatagtaggaagtggagaggcttttgtggttgctgttttctctgagaggtaaagggactggtggtttgaaatcagagaagggttgaaatagattctggagaagaacagcaacattgacaaggagatagggggatcatcaggtactcttagggggcacagttaaaggtggagctcttatgttgagtagttccagccttaccattgcagagccctggggcccacatttgtttctggaactaaaaccaccaggggcccagtgtccttcctgcttcttcctgctgagcctccacatcagggttccatctcaccacccagcaacgttccctgaccttgaagcctatcctttatctaaacgcaacacgctttcatccttgctttcctggttaactcctacccacctttctctactcagatcaggccaggactttttcagaagccttccttgactgttccccacatcccctgccatgtgagcaggaagtttcttctctatacccaaatagcccctcaaatacctattacagcataaaacatacagcactgtatcactgatttactcggctgcctctcccactggactgcaacaacttgagggcagagtgttttcacctttataatgatcactacttagtaggtagctcaatacatgtgaaattaatataggagaaaagaactaaagtccaaaaccgacacaattctacagggtcatgatgtccccagcccgtgtcacacaaagatgcttctaaccttagaaaccaactcacaaaatagagaaatatccttttggtctcaatattataccccttttccgttcaggaagaaatcttagtaaacccacagaaaggaaatatccttacattatattaaagtacattaccccttgctctctcctcttcccaaacacacaaagcaggaggcattgtataaaggcactttattttaaaatcaacacatcctgcttttataaatcagttactcttcatttccaacttccatcacctgagtttgagagcagagtgcgtggtatttttctgggcttaaggtataaactgacatggcattcaagaacatgtccagcgggcagagcccatcagggcaacctctcggcacctgctcctgcagaagaaacataactcagcaggtccgccgaggaacctgtccttctgctatttccagctaagcccagagatctgagaggctctgatccatgtggtatacatgtgcatacatattacagacaggaaggccccactacccggtgagcttccagaataaaagcactatgctctgcttgtaaaagtcactcaaaaagtgttgaattgactgggaagaaagagtcgagttacatccccgagctgggagaaccaacaggctcatccctggggcgtgctctggcctctgccctggaccccagccctgatgaagcagccaacaccacgggtgctaacagcagcacacatcacctcccaaagataccaccaacaatctccaaaacaggtctcacagccaggaggcgacatcctgacagggacgctcaggagaagaggagggggaccctgttcctaggagtctgtaacagaactgggataaggctcaagccccatcctgccaccatctgtcaagttctgcctgacccctgggccatagccaggagttgccctataggattcagagagctgactgtgccaagagagactccactgggcctgaggagggagacttggtgctaactcaggtaggtgggttttgcaggagggtgcctcaccaccacccaaccccacctcaggggtattaccttcccgtggtaatagagctgcacaaaccactccttagattccaggtgctggtaaagttccatggtcaggtcaacagcaaacggtggccatttgtggtcaaaaatccccagggtcattaagagcggtatgaaggtcacatcatgagccgcatagagatacagctttctgcaagaggaaacagctctccacaattctctgcctcaggactctgaaggtcaggatgtggcctgcctcctttacgtaagacacacttgcctcagaaactaggtgacatctagaaatcagctgagcctggtataaaagtcctttgcagtagatcgtgggaagaacccttgttcccactccccgtgtcttcatgaggagggtccccgccagagaaattctcctggcctcctccttgccacctactcactcctccctggtgagtttcaaagaagaaactgagcgtgtgtggcttagaccctacctctcttctctctttgggtcctgccagcctacatgaatgcccttcctactctcagccatgggatgagtttagtagggctccttgttggggaagcttgaagttttggggtattaagtttatttcaaaataatattcacaagcccatttggccctcagcacattctccaaatggctttaatctgtaataagaatgccattttaatctacatctgcctgacaccagtatccatctcttaggaaagaccaaggattttatttatggacccccatcctagaagactagcattggatcctgtggtgttctaaagatccaaggcagaaggtggcaaggtggcaaaagccagaaaaaatgtactgtcattgcaggtactgtgaaggacaggaaatggtattcacaagatttgctattacaaatcttggcccaaagttcctgtttcaactcactgtctcctattcctcttacgccatcatgagtttctagctgtgataccacaacagtgcttctccaaaattcaggtgactatcaatcacctggggatcttgttaaactgcagatgctgatttagtagatcaggctggagcctgagaacctgatgagttcttgggcaacggtgaagctgttttcctgcagaacgcacttagcaagtgcctaggacacataatattccacagccgtagtcccaaccttggattcaaggctccaaaagtggcaatggaggctcatgagctacttccaacatttttttttttttgagacagagcctggctctgtcaccaggctggagtacagtggtgtgatcttggctaactgcaacctccgcctcctgggttcaagcaactctcctgactcaacctcccgagtagctgagactaaaggtgcgtgccaccatgcccggataatttttgtatttttagtagagcagggtttcaccatgttggccaggatgttttcaatctcctgacctcgtgatccactcaccttggcctcccaaagtgctgggattacaggcgtgagccactgcacctggccacttccaatatttttaaatgccttatggatatcataccttctttacactcaatgaaagtggttcaaactacacaatccattaagcaatttatctttgttttggactattatcatatcaaatcagtgtgacatcataattggctactgtttgacatatcttcaattaataaaaaaaagagagagagaaagcaaaaataaaattttcaaaacatggtaggaggggtgcagcaggaagaaaggttaaaagattgtgaacctctttgacacttgaggcctgttaaacatctaccttcggtcactgacagcctggttcttgcctcactaagatttgggttccctccctacagccagaagttcccacggcccttagctgcacaaagcagagttgctgtgccaggtacctgatcttgtcgggggcagtggcagagtccacggctttcagcaggttgctctctaggatgtggaggaatgggcctactgccatctgaagactttccctgtgaaaagtgaacaacatttaagcacctagagggcactcagcattcaggggacacagactgattctgcccccaggacctcatgagtccagacagagctgagaaaaaggcaagtaatgcataagggccagcaacgggccagaaggagagaaatggcaccgagtccggtcttggggtcctctgtgaatgaagactcccaacaacacaggcaccagcacacagacctgttgtgaacacaactgagatgggaggggctgagggagcaggagagtggtaacctggataagccgtgaccaactaggccttggggaatcaaagaacaaagctgacaagctgggaagaagaaggggtaataatttccaggaattctagaaggcccttagaaaaataatcagaaggaacaagaacatccttaattttgtttcctatgtgccagccttccttcttttggagtttgggccataaagacatttcttatttatgtcttatttattttacagaagaagttcagtggtcgtgctcccaggcttggctgtgtggctccaccactttcattctcaggcctgtcacatcatggccacaggtgactactgcagcttaaagcatgttcactcacagtagtgaacaaagtccacttactatagaagaaagaaatgtttctcatctactcatcctagcagctgatcagcttccatggagacttcagagactggtcttctccttgtttttgtgcttctcactttttatcaaagagaaaaaaacacccctcctagaattcccagaacccagccactgacaaatgaaaacaaggttgccatgattggcttagacaaatccttatttgtggtgattgggtaaatgaccatctttataagtcaaggaatgttgcagcaatggatgaagagcaggcaaccaacactgtatgcaacacatacttttcagaagaatgtatacaggcaaagccaagttggatggccttgtgaggttgtaaccatttgtccttgaagaaatgttagttttacaaaaccagggctaattggaatggaatagacaaggtcctgtttaaaatgatttacaccagaataaagcaaactataccataggccaaatctgaccagttttggtaaacaaattttactggcacacagccatgtctatttgtttgcatattgtctttggttgcttcatgttacaagggcagagatgagtagttgtaacagaaattgcatgatcctgacagcttaaaatatttactaaatatgtgtgtgtgtgttgataaaggagagggaagtaagtaacaatttaggtatggtggcaccccttcacaagcagaaaagggaagctggcaagtcccagggagtggcagcaagctgtgtggcttggcaggaaccttctagatgccctaggcttgcacagaagtggacacactgaccctgagtggaaggaatgcagtcaggggctcttatccttgggcacccaaccgtgcaaattcttgaactgttagatgcctttcccccctactcatctttcccagggctacttcctacctcccctcctctatcaagtcacctatttttagtgcaagttgaatgctctcaacaaatcagaaaaaaaggtgtcttctgaaatttggtgagagaaaaactttccattctggtagtcaggaaacagaaccctaactgctagtaatatagcgaaaacacagaataggcagtcagtggatctgggtccaagttctggctccatcacttgctagctgggcctagaccaggtaggcaatatctcccagcctcagtttctttatctataaagccagggagaaaggtatctctctcacctcacagtgagaatgtgaaaatggtttgcaaattgtaacatgatgactaaagacagaaatgaatattctttcttcagctccccccacccaaatcctttaaaccttaaagcaaaaggaaaaggcaagtgataaagtcatgagggtggtggctcctggttctgcataacagggaacagaagcactaggccaccagtcccagctgtagaagtgcgaggacctagggcctactggtaggtgggcagaatggggttcagcctccttacacgaggagacatcagctgtcaggtgtgagtgggcctgatgaactcctcttccccatacacttggatgtctgaccaagcgtgacttcatgccagcagtgagagcccctcacctgtcttccttgggcagtatgtacaaggatgtgtccacagctctctgttcgatcatccttgcaaatctcttcagcatggggcagcttgggaggttgtgtgcctgaaagggccacatgtagttttagaaaaaaatgcttcttacctactgattctggcagctgatcagcttccatggaacctgcaggagcccatcttctcctggggaagagaagacaggctcaagaacagctatgtctgttaacaggtcaagaagctatgtctctaaagctcttccaaagctattactagatacctgaaggccaggaaaaaaaaaaaaaaagaaagggtttcttccctttctgatgactccccatccactcaaaaatgaaaagcatttttgttgtttttttggttttttttgagacggagtcccgctctgtcgcccaggctggagtgcagtggcacgatctcggctcactgcaagctccacctcctgggttcacgccattttcctgtctcagcctcctgagtagctgggactacaggtgcccgccaccacgcccggctaatttttttgtatttttagtagagacggggtttcaccgtgttagccaggatggtctcaatctcctgacctcgtgatccacccttctcggcctcccaaattgctgggattacaggtgtgagccaccgcgcctggcctgttttactggtttttttttttttgagatggagtcttgccctgtcacccaggttggaatgcagtggcgtgatctcggctcactgcaagctccacctcccgctttcacgccattttcctgtctcagcctcctgagtagctgggactacaggtgcccgccaccacgcccggctaatttttttgtatttttagtagagacggggtttcaccgtgttagccaggatggtctcaatctcctgacctcgtgatccacccttctcggcctcccaaattgctgggattacaggtgtgagccaccgcgcccggcctgttttactggtttttttttttgagatggagtcttgccctgtcacccaggttggaatgcagtggcgtgatctcggctcactgcaacccctgcctcccaggttcaagcaagtattctgcctcagcctcctgagtggctgggactacagacatgcaccaccacacacggctaaattttgtatttttagtagagacaggatttctccatattggccaggctggtctcgaactcctgaccttgtgatcctcccacctcagcctcccaaagtgctgggattataggcatgagccgccatgcctggcctgtattttttaacttaaaaaaaaaaaagatgaataaaatacaaagcaaggaattcataaattcctacttgatcttcattttcccaaaatgaagtctaaaaaatacgccatacaaatacatgatatgaactcttgccttctaaccttaaacctattttacacataaaagcaaggtgcatttctgcctttagggtacacagtcattttattttcacaagagtggggaggatcctatataactttggatgtccaacttttaaatctagagaaacctttcccattgttagtcttctttatgtatttattacagaaaaaaagatcctatggctaaataagcttaaggaaaacagatttaaagattaaccagctttctttatgaagggcatctcagatttttttaatatgctgatgtacatatagtactctcaagaagtgatgcaataaataaggattccaaaatttttagaccctactcatccctccctacccattgcccctgcctgcccaaacacaaactgcatattgggtgttctggggaacatgcctcaagaagctctggtctagagttcagtgtctgtgttcctacctgggtaaggagtcttcctcgattgctccctatccctcagtccccacacccattctatctgtaggtcttatcacagttgccttcaaaccaggaggcctccacccacttctctccacccggttctaactccggagccagcccaccaaggctattatcccaggctccccaaccccaggactcacctgctcggcagccacgttgtccaggaggatgaagaagtccactttatcactactgtcaatgcccatcctgtccttcacctttttcaaatcctctgagattcctggctgtaaagaggcagtctgcctccggcctctgacaaaaaataaaaagtaaagccttatattctatagtgattaacagtttacaaagtgtgcttcacacttgggttatcatttgggatatcatttaatccccacaacccaatggggttagctggtattatcccaattttatagatgaataaactaaggctctataaggtcaaatgacttataacgttaagttagcaagtaccagggttaggataacaggatgaaattttccaaatctcactctagcatttgcattgcatcaaaaatgatgcaagcatggcccaggtctgtctgaaaacagcattttcttttctttacggaataaataccatatagtcttagtgcagcctagagatacctgaaaagtgtcatcagcccaaaccgatctatcttacatagaaacatattggtaagagaagaaaaatctgtgtcttgttgggcttgtacaactggatttgccggttaaagacagtctcaatcatcttttatttaacctgttggttttctcatttgccccacctgagagaccggggttgtcagaaggatcatactttgtaaatggcaaaggcccactcgtggctgtatgtatcatctcgctagcccagtgtgcggctcttcccagaattcctggccttcaccatgggtctgtcattgtgaacaagacttcttcgcttcctagacagctgatgtcacacttaagtgtaatttaaaccttcccatccattattcgccagtagggtaagcctggacaggccctcagtatagacagagttctgccagcaaaggttgtaaaaggttgtccccaactggtgagcaagaacccaggggcagttacctggttctctgcctcaggctccagcagctttggtagttgggatacaagacttctgaatctgcttcatcagtgtggatgatgatgggtcctggaagaaagggaggaagcacaggcaggcagaggcttcagcttgttcttcccagcatctccacccccttctctttgtctacagagatggagcagagatctgctctgagaggcagatcatcaaggttactccttaaggacagaaaatgccttcaacatgccctggccctgccaaaggaggctctcctataatctgagcaatgaaaaaagttagtggcagcagccttgttctgtctagcgcaagccctcctatcgggccacaaatagactagagcaggtaatagacctgaaacagactggcaactccctgacaccttccaaaaaatccctgctgtaaagcactaccagcatttgggcattctaataaataatagtgttatcagaactaagttgcttcctgaagcctgatcctataggccactatggtgacttatcacataacaaactgagaaaagtggacacaaggccacagatcctctcagagaccccatagccttgcccaaaataaaaagccaggcttttagatgaattgctggtctaaccaaagatctaaccaaagaaactacaatgtttctcatatatctcatggcagctcattgctattcagaccccctcagtaccattgtcccctcccgtcaatgcccaaagaaagtgtcctaacgccttcccatgctttgctctgtgtcagagatggcaagtgccatctctgtgtggtaggttctttttccacactgctcaagcctgatggcaaaagaaggagctccccagcagcaatttgggattcactgaggtccatctacagagtgatcagctgaatcaaagtcccaaaggggtatttattcccaaattattgatagtcagaaccaagggctttaaaaatagcctataactttactagaatatcagaattcacacacacatcgttggtctggacagaagaagaaaccacactgaaagtcatgagtttagtcttcagtccagaactaaccagcagtcgccctgggaagtcactaccattctctggggttcatctgtaaatcaaaggggtaggactatatcagccacagaacctcctccaacctacggctattatgtaaagtataataataaaagaagaggtgctgatggctgcaaggtggagatcgaaagcatagtccacttgcatgtcccatcccctccttttctgtgcttcctcagacccctctgaagaatcctggggttctgcaagatttgttgtgaaaaggaaaaaccaaatgatccgatgccgcctccagatatacatgtcctcaaataaacagttgagcataaaaggaaaaagtaggattctgaaccaagactgccagagtttgaatcctaattccaccatttaccagttttgtgtccctgggcaagtcactgagcctctctgtgtcttggttctcttatctgtaaaaggggataatgacacctatcttatagggttactacaagaattaaacaagttaatatatgcgaagttcttagaacaaagtttgctgcatacaattggtcctccatgtccttggattctacatctatggattcaatcaaccatggattaacaatatttgagtaaaaaagaacaatacaaaataacacaataaaaataacataaattagaaaatagtacaggataatacacagcatttacattgtattgggtattatgtcatctacagatgatttgaagtacatgggaggatgggcataggttatatgcaaagctatgccattttataaaagggacttgagcatctgtagattttggtatctgcccggggagagggttgtcctggaatcaatcccttttggatactgtggaatgactgtactaagtcctttatgtgttagaataactatgacttaaacttataacactaataatattataaacctctaatatttccatctggagtctgatattggtgtctggattttggacccagtttatgataaataaggcacacttgagtagacaaatgtacattgagcaaatgacttggccagtgggcagaccaacaatctccagctttccccacagcctgattctctgtagcctatacgtaaccactgggatttttctaggattttactcctaaagcaatatcccaaagttgcaccatttccatcaacagtgccaccttctgggattctttttttgtttgtttgttttttgagatggagtctcgctgtcacccaggctggagtgcagtggtgcgatctcggctcactgcaacctccgcctcccgagttcaaacgattctcctgcctcagcctcctgaatagctgggattacaggcgcccaccaccacgcctggctaatttttgtatttttagtacagatggggtttcaccatcttggccaggctggtcttgaactcctgatctcatgatccacccgcctcggcctcccaaagtgctaggattacaagcgtgaactactgtgcctggccccttctgggattctttgttcaagtcccttcatataggaaaggcatggaagtagctacaaaagaagccaatctggagtcccaacaactgtaggtccagcgcagggagctgctacccagacacctgcacctgaggctagtgatttccttccctgatggaaacctgggacattcccagtctgggacctgcctaaagagaatgttgccaccaataaacatctttccttctcagtaccacttctgatgtttctgagaagatctttgccttttagaagctgagcagttgagagctttcagaagatcaggtgctgtggatcactcctaaactcaaggcttcccaagaagtaaggggcagcccatcctgctttatgtgacctagacacgtactgtttgtgtgcagcagccaactacagccagaactagcagcagtatccaacccagttgggggcaagaccagattcctctttcctgaaggttccattattttacatatttcttaaaaaatgtgatggaaattttgtttccatttgagatactgccaaaaagctaaacaaagtaacaagaacctttgctttttggcacctttttaataaggtcatgatgatctgaaactcagaccagtaattaaatgtaaatttgagccaataacaaatgacaaaatgcagcttcatgtgatggccaaaggctctcaacacatgggatccatgagggaaaataattaatgcagtccttggggatgaaaaggttgggaaccactgactgcaaccattcaggggctgaatgtatcaaaacccaaactcgatggactttctcaactaggaaaggctagacggaacagtgttcatgctgtggattatcaccaagattagggcagtagcagcagtgttgggtcccagtgtccttcctttccagcaatgtctcacctaaataaaaagccccctcgattgttcacaaaacatggttaggactgccttgtgcagcttgtgtagaagcttgaggggagaagccaggagccagaggcagatcagagcagctgctacactgctgctgctgtggaggtcaggctggcaggggcaccataaggccagacagggaaagacccactggactaggtacacactggaagtcacacatgcaggagaaaaaaagtcaagggaacaggcaccaagaaagagataggggcttcggaagtgagaagcaagacccctcagggacagggactgactgggaccccaaatacgaaccttctttctgacactggaaaagcccagccagcaaacaacgggtggactccagattccgaaaaatgttagtggaacgaatactgaaaaaaatgagaaaatagtgacactcataaaaggaatatttaattatatacactctattttattccacatacgctccaggggtctttcaagagtacataaggagagctatggaactaggaagaatgcttcacttttctgtgggatgtcagcccctgagagactcgaagtgcaatgaatgcgacctccaggaacgacctgttcaccagatcctgtgacataagggtatgcagcatgacaagttgtcccccaaactaccttgggtgacagtgggaaccatcttggggagtcaggacaggtatcctcatgttcaagaccttaaattaagtgcaacatcccctttcaagtgactcacaagacctcctgtgggttgaaggttggtgaaagaaagggaatgtcttccacatagttcttcctcagtctctctcccaaggcaaacatttgctgcatgcccaccttggtcagctgcccagcaaacatgcccccctaaagtagggaagaaagagaaagaagaatgaaaacacctgacagcctgctgaactcagcccagagaaaacaacccaacctttgcagtggggctccccagagcaaggaagcattgctcaccttcagggtggtctcatggtattgagagtcgtaaggagaatatggtttcggaccaccagctagattggtgactgtgtaatcaaactgagtttggggtgggacctctaatagctgggggttccactctacctgttagtacaaaaaaaacacaccacattgtttaaaaatggttcttgaaatgtatagcattaacatctcaagcactcagaacacatggctggaatcactgacactaggcctgcaaccttcctatgggatggaaggaaagaaatgttagctaaaattaagggaagaaaagatggtgatttattattccaggtgtccttagcctatgtcctgttattgctacactagtaatgactgctaaggggctgctctggcacttagcccacactgaagtaaaggggagaagtgaccagaatgcctggcatgcggatacgtggtgaatgaacgaatagatggatgaaagaaataagatgtcagtgaccatatgtaagaatttataaggaattaatctggaggtttatatgccctatcccagcttaaggattctacttaatgtcccttgtaactaatatacttttttcctcctttcatgcaattcgtgaaacaagcagctgccatctcagaagatgttgctttttcatcatcttccattattccttgcaatctggctcctgccccaactgtgctgtaatgatttcaaaacatcactagtggccacaggtctcatagctccaactgttcataaaactctgacactcattgagtcagatgtgaatacttcaattttaaaaacaagtctaatcccatagaccagttccccttcccaatctactatgtccctctcaatgttaccacagttctcctaggccccaaacctcaaacctttggctccctgtggatccactatccccacaccaagccctgttgatcactgcctagaagaaaagtccctcccaatggtccttccattatcttattgtagaatgtaaaccttattagtgcctgtgacaaactcctccctttcacctgcacaatccatctatccatagccaactaattaatctttttggaaaaaatatttttattgcatttaaatattttgttttatttttaattgacaaataattgtatattgtatatatttatggagtacaatgtgatgttttcatatatatttacatttgatatatgattaactaatgtaaacaaaatccatcagctcacatactttcatttttacgtgatgaaaatatgtaaagttaaccttttagtaacataggcatacatcattttattgctctttacagagattgcatttttcacaaattgaaggtttggagaactctgcattgagcaagtctatcagtgccatttttccaacagcatgtgctcattcatgtctctgtgtaaaatctggtaattctcataatattccaaactttttcattactattaaatctgtcaaggtgatctatgatttatgatttgtttttctttttgaaatggggtctggctctgttgcccaggctggagtacagtggcatgatcttggctcactgaaacgtctgcctcctggagtgcagtggcattaccttggctcatcctctcacctcagcctcccgagcagctgggactacaggcatataccatcatgcccagctaatttttttttttttgagagacagggttttgccatgtttcccaggctgatcctgaactctgtgatctttgatgttactattttaactatttgggagcgccacaaaccgcccccatataagatgccaaacttaatcaataaatgttgtgtgttttctgagtgctctgctgactggtatttcccccatctctctccctctccttgagcctccttatttcctgagacacaacaatattaaaattagtccagttaataaccctacaatggcctctaagtgttaagtgaaaggaaaagtttcaagtttctcactttaaatccaaagctagaaatgattaagcttagtaaggaaggcatgtagaaagctaagataagccaaaacctatgcctcttgcaccaaacagccaagttatgaatgcaaaggaaaagttcttggaggaaattaaaagtactactctggtgaacacacaaacaatgagaaagtgaaacaaccttattgataacatggagatattcaatgcagaagaaacagcctatataggaagaagatcccagctaagactttcatagctagagagaaagtcaatgcctggcttcaaagcttcaaaggacaggctgattctcattagggattaatgcagctggtttccttaaggtgaagccaaggctcatttactattctgcaaatcctacagcccttaagaattatgctaaatgtactctgactgtgctgtataaatggaacaacaaagcctgcatggcaggacatctgtttacagcatggtctacttaatattttaagcccactgttgagacctactgctcaaaagaaaaaattgattcctttccaaatattactgctcattgacaatgcacctagtcacccaaaggcgctaatggagatgtacaaaattaatattgtttttgtgcctgctaacacaatgtcctttctgcagcccatggcccaaggagtaattttgactttcaagtctttattatttaagaaatacattttgtaaggctattgttgccctagatagtgattcctctgatgaatctgggcaaagtaaattgaaaaccttatggaaagaattcaccattctagatgtcattaagaacatttataaggaggaggtcaaaatagcaacattaagcgaagtttggaagatttgactccaaccctcatggatgactttgaagattcaggcttccgtggaagaagtaactgcagatgtgatggaaatagcaagagaactagaattagatgtggaaccttaagttctgactgaattgctgcaatctcatgataaaacttgaatgcatgagaagttactacaaagaagtggttccttgagagggaatctagtcctggtgaagatagtgtgaacactgttgaaattacaacaatggatttattacataaacttaattgataaagcagtggcagagtttgagaagattgactccaatttcaaaagatgttctattgtgggtaaaatgctattaaactgtgtcataagctacagagaaatctttcatgaaaggaagagtctatcaatgtggcaaactttactgttgtcttatttttagaaattgccacagccaccccaacctttagcaactactaccctgatcagtcagcagccatcaacatcaaggcaagaccctccactggcaaaaagatcatgactcactgaaggctcaggtaatcactagcactttttaggaataaaacatttttaaattaaggtatgtacatttttagacatgctattgcatgataggatacagaagagtgtaaacacaacttttatatgcactgggaaacaaaaaacaactgtgggtctcactttattgcgatatttgctttattgtggtggtctagacctgaatctgcaatatcttcaaggtatgcttgtctgtgtagaatctaaagaagtcaaagtcacagaattagagagtagagtgatggttatcagaggctgggggggtgcagtaaatggggaaagagagatttttatcaatgggtacaaaatttcagttacacaggaagaataagctttagtgatctattgtacaggatggtgactacaataaataataatgcattgtatgtttcaaaatcacctaattaatcttgctaagccagtgtcatcatatcagtaactttttcctaatgtctcagaggaaagcatctgtccttcaagaacttctacatcgtggctgagtgcagtggctcatacctgtaatcctagcactttgggaggctgaggtgggagcatcacttgaggccaggagttcaagatcagcctgggcaacacagcaagaccccatctcttaaaaaaattttaaaaaaggacttctaccccctttgtccagcccctgtactcagcttcactgcctctttcctcccctccaacctagaacctgcccactgtttctgcatcttcttccagcttgcttctcttgcttggagggactcctgttcctatctgcccatcaccttgtcttcaatgttcaaggatagctcaagtcttacttccctatcactgaccactctggcttttgatggttatcttttaaatctgaattcctataacattgataacaaaaaaaaatttaactcaatttcctactactttgtttagttttaaaactaacatttggaaacctactatgtcacatatcgtcatatttatcttctaccctccccgaactatcccaggagaatggtactgggagcctcagattctcttggcatctagggagccctccattcttcccaaaggcatgtgtcagtcccactggcacctggtctccaacacctgaacctccttctgacacatcagaggaccaggtgttcacagagaggccttcttccttctttcacagttaatcactgctccctctttctgaccctctaacccctctggataaaaaaaacccttcgagggttcatggctcatgtggccccacctcctctctagcagcccccttaccacttcttccctattctacatacttactcactagccacgcaacttcctttcctttctcatatttcatggcctttcagtatcatgtttcttatgcctggaattttctctcctcattcatttagaaagacttttgttcattccttaagacttagcttaagtgttcccagaaaccttggtcatggccttatgctttcacagtagcttcagtggctctctttagtagcctttaccaaagtgtattaaacgagctcctttactggtctgtcctggcttcctgagaacagagactcggtcatctattgacttctgtttcccagcaaagggcctcacacacagtaggtacaattaatagctccaacaatttgccagctcctgtggaagatacccatcttgagaaaacttgaccctgcctttcctgggtgttcaagttagtaaagaaaaaaggccagctgtgaatgtaaatgacagcaataccataatagaagctgacatgtgctgcaagaaaccatatgaaggccatagcagttcaaaggcaagacagaccttctcttctggctggggattcaggagaagtttcattgagggaatagcattttaaatgaatagtatttagacaagcaaatacctgtacttataaagggtgacattcagaattccaaaaataactagaaagcttgcgcaaagcagagatggtaaagaatgtgtatggcaaagaagtggtttggtttgcctcaacctgggaatggttttccaatttttaaatcagaaaataccacataaagtttaactttagatttgtatgtataaaggcaaaaactcgaatttctctagttgaagtaggagggaatcccacagccccagccgctcaacatcctcttagcccacaggctccacagaataaatctgaaacctggcagcatacatcacaattggaatgggaagactagatgcagaaaagcccattttgagatgttagcaatagtccacatgagagcctaaggcctcatctaagccagttaacaatagaggaggtagatgtaagacatttgagttagacttggcaagtgagtaaataaaagctttatgtggggactgtgttggtaggtaaacacagaagaacaaaaaagagactactttgatttttgagccttgtaatggagatattccttgactaaaactaagaccaagacagaaaaacaggtggaaagctgatttcagttttggacatttggagacacctcctttgtgttcccagtgctcccagcatattgccttaattgatatctgttgtctctgctttatcacattgaaactcctttaaaggcaagactgaattatccatccttgtagttccagtgtccaccacagggcctgacacaaagctccacagggccattcagcctcactaagaaatctgttaggcacattcaccaagagaggacccttggcgtctcctaggagtctggagtccaggtcacatcaagtctaaagtacagttttcagattttcaagaatggatgatacatcagtttcatataatagtgtccaccccacatacacactctcattctcattcctgctcttaagcttcccagttagtggcaaagactaacttgataattttacttattttgtgtatacccctcttcaaggggtaataaagtagatatagcaaaaattaaaatatagtaagacaaccaattcaaagtaggcaagaaagacaaaagcaaacaaatgtagggacaaagaaatggatgcagtaacacggttactaaaatatgtacaccatgaagatctgtttacttactataggtgggccacagacttggcacccagcttcctgacttttacataaagaaacaaacttgatcagctagactagtttaaagaaaaaagcaagccaattgttcaggagaagcacaccattcctaatgctaacagacaaattcctcccaagggtcctcataaagaggatagagtaatataatgaacatcttttcagcagtcacagcaatgagttctgtgggattgtttctcctagttctctcaacacagaaagataacctcttaccaaagcacatttcagcgaaggcaattctgtactgggattgatatactacattccaggtaaaagaacaaatctacataaaagtaaacaaaaacctcccaggtgtagattttaaaataaagcaatcatattaaaccttgtctgtatactggtattaccaggacattttttaaaagttactgatgcctgagtcccaacctgggataaccgcatttggattatcccccaaaaaagtggggcctccacttttttaatgctcttcagtccagataattctcaagcttcaccagagagtcttttacattatctggataccccggaccaattaaattagaatccttcggagggagaccctggcatgtgtattttttaaagctttccagttgactccaatgttcaccacggttaagaaccatcgatcctgaagaatgggtggacctcatgtaatgcttcttgaataccgcttcttttagctgagttttggaaaggtactaagcaataaaagattcttacattatgcttcccagctcatctatattgtcaaataaatagggacccaaatgtcttaatcaacagtgaagctggggtaggttggactttattttataaaaactgaggaatctccctgggtggaggccatcttgacacccaggggagttgagggaagcctggaagcagtgccaaatcttttcttttgatagtgcatttggatctgctctaatgatcaggaaaaaaaatggccaatcaagttctatatttttatttccaaagcacaatcttttagcaaaacaggttaaaccaacagccattcaagccataagaaaacaacccaataaaacactagttttttgttttttgtttttgagatggagtcttgctctatcacccagggtagagtgcagtgacccaatcttggctcactgcaacctccgcctcccgggttcaagcaattctcctgcctcagcctcccgagtagctgggattacaggcgcccaccaccacaccgggctaatttttgtatttttagtagagatggggtttcaccattttggccgggctgatctcgaactcctgacctcttgatccacctgcctcagcctcccaaagtgctgggattacaggcatgagccaccacacccagccaaaacatctagttttaaatcatgctactttctgagaatttgtgagatggctgaatgaagtgacttgtcacatatattaatctataaaccagtcagaaatcaggaaacatgtaccaaagacaaaaaatttttgccaggcagtcccttctgactataattaatagcagaaccaagaagattaaaaaatcccaataacggccgggtgctggctcacgcctgtaatcccagcactttgggagacttgaagcaggcggatcatgagatcaagatatcgagaccatcctggccaacatgatgaaacctcgtctctagtaaaaatacaaaaattagtcgggcctggtggtgtgcacctatagtctcagctactcgggaggctgaggcaagagaattgcttaaacccgagaggcggaggttgcagtgagccgagatcgcgtcactgcactccagccttgcaacagaacaagattctgtctcaaaaaaaaaaaatcccaataacaacctctatcaaattggatcttgaaatgaacactggacagagactatccagaaacaagttttaagaggctaatatttgctcatagcctaaattgaaagagagttggttcacccctgattttcatgcacacaactttatactagagagccgaagacgtttaaagcatctgtctaaagtctggagaatatgagcagaaaggagaggtaatatgccttctctaattgcaaagtcaggccatggattcagatgctattttgtggctacacagattgaagatgaatgaagctggtatcctaagctacaacggacctttcaaccataaaggcagaagatatccatcacacacccactctcccttagggataaagccctaaaagaatctaaatcttttcctagtgccttcaggatatatatatatatatatatggtacatactaggtctaggcctacacattcaaagttttactctccattaccactgataattttttgtcttctacgtgaatataatatatattcctacatgtgattccccagtccttctgtaccaagaataaatagagaagaattgggggaaggggagcatcagagatgggctgtatacaaaatcataaggaaaatttagtgatctaatataaaaaggcaaagtaagagactgaaaaaaaaatcaaagaatcaaaatgaaagaagaaatcccggttccagagagcaagtggtaaagccagagtaaggctaactagaaacctggtaatagaattaagtgccttccaaatgtatttatttatgtggaaaatgctttagaagtttaatttcatgtgcggccaaccttgaaaaatgggtttccagttgtacaatgtaaagacacaatcctgaaggtttctagaaagcaactgttattatgaagagtatacctaacatcaattttggacaatcttttcgacctcctccaacatcaacctggaagaccaacgatacaaaagcactccacaggtgtaatacctgggagtttggggatttcaggttgcctgttcctcttcactaggcctttctgctataaaaagtcacatccaggaaagataatcattttttttttaaactatttgtgctttagtcataattatcctgacaaaaccagacagatttttaaaacattactgccacagactagcccattttaaatttgttccgacctcagatccctcccactataggtttagtaaccttaaatagaaaaggagaaccctagaatacaacacttgttacaaaaaaaaaacttcaggagatctcaaatggcctccagcaaaccctgagaaaaagcagttataaagtttgtttccaaaggcaacgacctcttatccactgtaatctcagttaagagtggttcctatcactaaagtcccttcagcccttcagctctgacaaaccaccttcaaaatggtcacacagaagtgcactgcacccttgtattcaagttcacctagacccttaatagaaatgctgacctggggcactactccacacctgctgaatcagaatctgcaacgtagcaggatccccaggcgactcccatgcgtcttaagcagcgcttactgatggctgcgccatcagggcaaaactggaagttccggggctgtcctaaccccagcaggtcctttgctcaagagcctggggagtcactggctactgctgttttcccttcttctggacccaacccgagccccgctccgcgcgagtaaagctctgaagatgtgtgtcagggcgagactcctggcctggcacacggtcctcgccccaccagccccagcccgggccgacctctcacctgctcctccagcgggagcggcttgagaggactccgagccccgtgtcgaaacacgacctgcaccattttcaacttcagcaggctgcggtcgaccggacactggccatcggcctcctgcagctcggccagggccacccgccgctggtgcaggcagtacgccagcgaggtcaggacgcccactggggtccacaagcgcatgctgaacacaccagtgatcatggtggtaggccctcgctgccctccgggttgaggctgcaggaggcaaacacaagtcttctgcgggcgccggggctcagcgggcgcccccaagtccgcgggaacctgcggatgcgtacatccagcccttcagcaagcagggaccgctgtgcctcccggccctgagggagaccccgagtgggaacgggggagagaacaagaggtggcagcagcgaagagtccctgggagttttaacccgggtcggggttggtcgctcctgctgcacaccgggccgggggagatcggatccttatcttttgcccgacgaggaacattaaacttgtatttcaagtttggcctccagcactcttgaaggaacaggagccggccctgagttccctggcggcagcggctccaccagcaaggactactcgattccacttttctataagcaagctcctacccacctcctcacctactcagggacccgtcccaagtggacccgcgcacaggagcacgggaaaacgagtcctgtggtgacacctcgcctggagactcagagctgcggaaactacaactcccacaaggctgcgcgtaccgcggctcccaagaagtggcttgtacccgcccccctcgcctgcgggcctcgcccctccggcccagccagccgttttccaggcgtggatggcccacggacgtgcctggtccggcagtggagtggtagtgaatctgtcgggccatggagtttgccaggcaggaggatcgcgagcgcaggagtagaactgggtggtggaggggagtagtttgagtctagttttgaatgtagaagacttccttccagtcctggaagcctggttgctgcagcgaggagctgagacacctgccgagtgattgccatttgcgaaacacagcactaggtgctttatatttagtcatttactactcccttctctgtttttaaaaaaattctcaagcttaagtcattgtaatcatgtagaactttcaggtcactgatgtgtttacttccatccagaatacttcttgtggaaaaagccaggccttgcctgtgggtgtcccagtgattaagaacctaagaggcgccatggctcacgcctgtaatcccagcactttgggaggccgaggcgggtagatcatgaggtcaggagatcgagaccatcctggctaacacggtgaaaccacgtctctactaaaaatacaaaaaaaaaaaaaaaaaaaaaaattagccaggcgtggtggcgggcacctgtagtcccagctactcaggaggctgaggcaggagaatggcgtgaacccgggaggcggagcttgcagtgagccgagatcgcgccacacgactccagcttgggcaacagcgcaagactccgtctcaaaaaaaaaaacaaaaaaaaaacctaagaacacagaacaatgccagccttaccacctgctagtctggtttctgttgatatacaggtatcccaagcctgtgtttccagatctttgcaacaggacacaatctgggacccactatgtgtctatctccaaagatcaaactgggccagatgtaaagacaacatacttacagagcatggctcctggcctgagaacaaattctgttcaccaagctggaaggttctgagtgctcccctccctgatgcagggaggagggtcattttggaacactacatattgtcacaattttctccctagcccagccaagggactcacttttcagagtcttattgtgtgtgctgatgtgattaaaaatcgaatactgtttgctatggactcagttgtgtcccccgccaaattcgtacccactaagtgactgcatttggacataggacttttagaaggtgattctgtcagaggcatttgaaccatagtgactccatcttgaatagcggctgggtaaaatgaggctgagacctactgggctgcattcccaggaggttaggcattctcagtcacaggatgaggggggaggtcagcaggactggtatcacaagaaaccagtcaaaaagaccctgctgataaaacaggaagtggtaaagaagctggccaacaccaaccaaatgcaagatgttgatggaagtgacctatggtcaaactcactgctcattttacgttaattataatgcattagcatgctaaaagacactcccatcagcactatgacaatttacgaatgtcggggccagcagttaccctatatggcctaaagtggggaggaaccctcagttccaggaaatcccactcctttcccagaaaattcatgaataatccaccccttgtttggcatataattaagaaataaccataagtattttcagttgagcagcccatgcccctgctctgtctatggagtagccattcttttgtttctctttttctctaataaacttgctttcactttatggactcgccccaaattctttcttgcccgaggtccaagaactctctcttggagtctggatcaggacccctttccagtagcaattttggttaagtgaagatataaatgtgaggtcctaatccagtaggattgatggctttataagaagagaaagaaggatctctctctccacacaggagatctgatggttttataagtttttggaaattcctccttctttctcctctctggtctgccaacttgtgaaaaaggtgcctgcttccccttctgccatgattataagtttcctgaggcctccccctgtcctcagccatgcagaactgtgagtaaatttactcctttgtttataaattgtagtatctttatagcagtgtgaaaacggactaatacagcaatggtcctgtcagggctcatgtgtcctgttggagggggagtgtggggaagtgtggggaacaacttagcagcagatctccaaaagaaaccagagtgagggtggaaaatagcagatttcatgtggttgttaaaagcactgtttgtcaacacatgtgagacaaaccatggggagtccagatgtattttgtgtgtgatagtagtggcagtgagctgcaatttaaaagaggctgggccgggcgcggtggctcacgcctgtaatcccagcactttgggaggctaaagcaggcagatcacctgaggtcaggagtttgaaaccatcctgggcaacatggtgaaacgctgtctctaccaaaaatacaaaaattagccgggtgtggtggcacacatctgtaatcccagctactcgagaggctgaggcaggagaatcgcttgaacctgggggcagaggttgtagtgagccgagattgcaccactgccctccagcctgggcggcaaagtgagattccatctcaaaaaaaaaaaaaaaaaaaagagagagagagagagaaagagagagactggaagtcctgacccagggtaggaccgtgtgggtgggggtgttagggtggttgcaggaagcaggggaacactgagtagctgttattttgaccctggttttaaactaccaggcagggatggctcgggaaataagccctttcccagccaaattgtcttcagaggattgcatttaatattatgtaaaaactcagttttaataatgagattagataagaaacaaccacattcacatttttttccccagtggtgagcacagtgcctggcttgtagtaagtactccataaatacttgccaaatgaaattataggatatatcataggaatgttgttgagccattgctcattacatcatttattgcttcctttataaatctcctcctgagaaatttggtttagagtgttagaattagaacaagcattaagaagtatgaagattacttttccttcaattttgtcttggttgtcaggaagcttggtgcctaattttcaaacttacctatagaaaatatttagaatctagtggccagtataactatgatctttccctccagagtattactctggattggatgggagcaaaactggagaaaggaccgttaggaggctgttgcagcaatccagctatgaaacatgtaagaggtagttaacaagtgagaaggaggaaggagtcaaggatgactactctacgtttctggcttggacaacctgcagatgatgccatgcacctgggaaggaggttaagcagaaatgaccaagttaattttgaatatgtagatcataaggtacttaggtatcaaggaagccaagagaaaaaaggtttttttaaaaaagagaatggacaatagtgtcaaatggaactgagaagccaagtaatgtaaggtccagtgtccaatggatttaacaacaaagtaatcttctgttagttaagtgagagcagtctcagtgaaatagtggaatcctaatccaataatggggcagaaatggaatgcaagtgggaagtaagtgtagacatctttaagaagcttagctgagaagagggaatgaaaaaatgcagtagctggaggtgtttgattcatgaaattaagggagaattgtcttttgaagatgagagaagcttgtatatatgtttaaatgttgatagaaataagtttccagataaggagagacaggataatagatctgattaagtgcttaggagggcaggataaaatcagaaatgagcttaagtggcataattagcttcagaaagaaaaagtatgtattttccatgtttataggaggggaataagaaagaataggcatgggtgaaatacattcatggcatggagattcatggggcttttttctttgtttttttttttttctgcaaaatcagagtatgagttagaggggtggtgattggtgctcctgacaatttgaggaatgtgagaaagtaaaatacccacagtatacacaagagagagggtcacagctaggtagccagaggtttgccaggtaccatggagagcccaatagagaacagttttctccaactttatggtacatcataatcacttggcttatttgttagaatgtaggtacaggagcaccaatatgtcttactatagccgagtggagtctggaactctgtgttttaaacaagcatccaggtgattctgatacagaagctcttcagatcacacattgaaaactatggatagagagtcaaagaggggttagttttagttttagtatggaggtgttttttataaaatgggtgctatagtttggatgtttgtcccctctaaacctcatgctgaaatttgatccagtgttagaagtggggcctaatgggaagtgttgggtcatggcagtagatccctcatgagtaatagattgatgccctccctcagaagtgaataaattctcactctccaaaagctagttgttaaaaagaacctggcacctccccacctccttgcttcatttctcatcatgttatctctgcactcactggctctccttcatcttccaccatgagtggaagcagcctgtagccatcacctaatgcatatgcccaaccttgaattttccagccatccagaattatgagccaaataaacttgtttctttataaattatccagcttcagatattcccttatagcaacacaaaatgaactaagacaatgaggacaattcccaatggaggggaaacaagaagacaaaaagaaataattggtagagaaaaattcctaaggagttgagagaatgtgtgataaagaagaaaataggaagggtcaccctcggacaggagagaagggttgcatctttcattaagggtcgtcacttctattaaaatgaagaggaggaggtaaagatagatggtgaagcagggaagattggtagtttcacctccaacaaattatttcccccagttatatctccaggaagcttggaaaaaggaaaaacatcaataatagtaattgaattaagtgcttaccataaccatatacatggcattatgtaatgtgacatttaatccttatagtaactccagttgtaggtactatcaccattttgtaaaggaagaaattgaaattagagaacagagaagtaacttgcccaggaatgcacagatcttaagtggcagaaactgagtaaactaaatttgaacccatatttgtctggcatctgggcccacactatgagtcacagatattacagatattataatgcttaacttatattagggagggggtagcaatttgtgtgatatttagcatggataatacccctgtaagatgagagattaaaactttcctttgtgacttctctccaataagtctcttttttcctaccattttctcaatcctgatggatggcttcctgttttttccttaatatcacttaggttctttctgttgcaagtggcagaagacctgattcaagctggtttaacaggaaaaaagacaaaagaattgattagcccacacaattgaaaatttcaggagaactgccttcaggcttagctggatagaagctcagttaatattgattttttatttcttttgtagcctccagctccatctcctactgttttgtctttgtcctcaaactttttctggtgactcagagctcaccccttcattacacaatgactcaagcagtctaactggaaataaagagctcttttccccacacaagcagaaattctgggcctcagaattttttgccagatttgagatatatgcttaatgcttgaaccagtcatttccaaccatccctgaagttgaaggggaagtcaaacccacccaaactaaatgagctactagggggtacaggcgattcttcaaaagaggttcagataactgtttttactttaaaaagagtgaatgaatgatgaggggagaataatagatgtctttcatgcctttctccaatctcttctttcctcattaatcaacttcctgtatgcattgttggtgactcatgctgaagttgctgacctttcgacagagggacagagggaggtgggcttaatactctctacaactcctacaactctaacagagtacgtctgtgtctatacatctttgtgacttccttgtttaaacatctttattggctccccattgcccacagaagagtgacttacaataccagttttcaatgttccaccactctgatattccatgctgttttcaaaggtactagaatactggtatttctgttggtatgatactgttagtttgaagttaaaaaaaatctgaaatctgaaacatttatgttctgagacataccagagacacgtttcattaaaatttgggaatcacgtataggtgactgtgtttagaaagctgtcttatatgcctttataatcctcaagaaaaaagaaaacaaagcaaagcttctaatacaagaataattattatctatcacaaagactttccaacacatggacatgaatggaatactattggtattaacaaggtgtctgtattagaatctttatttatggaagatgagatggaaaaataaagacaaaccagaaatactttcgttgaagcaaaaaaaaaaaaaaagtttgttactgtcttagtccattcaggatgctgtaacaaaatatctaagactagataatttataaataatagaaatttacttttcacagttctgaagtctgggttatcaaagatcaaggtgccagcagatttctcatctggtgaaagtttgctctctgctccacagatggtcctgttgttgcatgatcatatgatgaaagggcagaagggcaataaagggctaaatagggagaactcactccctcaagcccttttttatgggcactaatcccacccatgagagtggagccctcctgaactaatcaccttctaaagaccccacctcttaatactgttgcactgtgttagaaatgcttgtttcctggtgccataaagaaatagcacttgaacataaatttaattttctcagcaaggccatttttactttctgcagaaagggtacactcaccagcagttttgccatgagagtacaccgaacaaaggagacaaggttatttataacctcatgcgtccaccctactgctgtgtccggtttccattggttggaacgggacctcacattctgtatttgtcccaattggcttgcaacttagaactttttaaaagaggcaaaggcagtggagaacaaaggaaggaggaggtaacttgtggaatgctgagaaaggtaaaaaacacctccaaataaagaagaggaacaggcgatgacctaacgcttgcttggaccagtataagcatgccagggcaaatatttaggctaaattgtgggagcgaagaacacaaagtacattgatttctttattacggctagcagatatctaagaatgttagcacaggtctttgaataaatttgcttctaagtgaaatcactatttattcctaattagatggggaggaaagtctttttgaagaggaacctttactttactttttacaattggaattatgtttcaacatgaatttttcagggatacaaacattcaaaccatagcagttagaaattaaaaaaactgttcttgcaaagaaatgtaaccttggcccctgaaaaaaatctcctcaaagttgttaaccaagagataggattgttggtagataatgggtgtcttagtctattttgtactgctacagcattaatacctgagaccgggtcatttataatgaacagaaatgtattggctcacagttctggaggttgagaagtccaagattgaggcactggcatctggtgaaggccttcttgctgcatcatcccatggcagaaggcacaggggtgagagagagaaaagggggctgaacttgtccttttataaggaacaggttcctgtaataatggcattcatcattcatgagaatggtgctctcatggcctaatcacctcttaaaggtcccacctgtcaacatacttgcactgaggattaagattccaatgcatgaactttaggggacacattaaaaccatggcagtggattagagaaaaatatttaagagcagtttataacaagatctttatcattctcttaactagcatagattcagaaagaggttttcagcactggaaagctttacacagctcagtgatgacatcattgatggactaagtacacattaaaaaattataattctattttatttttaagctcaaactttatgtagtatgtggccaggtgtggtggctcacacctgtaatcccagcactttgggaggccgaggcgggtggatcatgaggtcaggagatcgagaccatcctggctaacacggtgaaaccccatctctactaaaaaatacaaaaaattagccgggcgtggtggcgggcacctgtagtcccagctactcgggaggctgaggcaggagaatggtgtgaacccagcaggtggagcttgcagtgagccgagatcgcaccactacactccagcctgggcgacagactgagactccacctcaaaaaaaaaaaaaaaaaaaaaaaaagttcaagtatatttacattttacttatggttattaatttttgtatttgaaaagtgttgtgtcttaatcagcaagatggcagaaaataactttccagtgctagtctctccacagaaacatcaatttgaaaaactatccatgcataaaaataccttcacgagagtgaagaaaaccaaatgagagattacagcacctgagtgtagcacagaaataagaaaagacacattgaagaggataggaaggacaactttacattacccacatcacccttacctccataccaggcagcacagtccacagagagatacctttcacttcggggaagatgaggaaaataagcatcagactttgcctcaaaccccaatactgggcccaccgataaaacccagcactgggaaggcctccacagccccagattctaggcccatgatgtgtccagaattggtgggttcttggtctcactgacttcaagaatgaagctgcggaccctgcggtgagtgttacagctcttaaggtggcgcgtctggagtttgttccttctgacattcggatgtgttcggagtttcttccttctggtggggttcgccgtctcctcggtcaggagggaagctgcggaccttcggaccttcgcggtgagtgttacagctcttaaggcggcgcatctggagttgttctttcctcccagtgggctcgtggtctcgctggcttcagcagtgaagctggagatcttcgcggtgagtgttacaactcataaaagcagtgtggacccaaagagtgagcagtagcaagatttattgcaaagagctaaagaacaaagcttccacagttgtggaaggggactggagcgggttgccactgctggcttgggcagcctacttttattctcttatctggccccacccacatcctgctgattggtagagctgagtggtctgttttgacagggcactgattggtgcatttacaatccctgagctagacacaaaggttctccacttccccaccagattagctagatacagattgtcaacacaaaggttctccaagtccccaccagagtagctagatacagcgtgtcaacacaaaggttctccaagtctccaccagagtagctagatacagagtgtcaattggtgcattcacaaaccctgagctagatacagggtgctaattggtgtgtttacaaaccttgagctagacacagagtgccaattggtgtatttacaatccctgagctagacataaaggttctccacctccccaccagactcaggagcccagccagcttcacccagtggatcccgcaccagggctgcaggtggagccgcctgccagtcccacgccatgcgccggcactcctcacctcttgggtggtcgatgggactgggcgccatggagcagggggcggcactcatcggggaggctcgggccccacaggagtccacggagggggtgggaggctcaggcatggcgagctgcaggtcccgagccctgccccgtgggaaggcagctaaggcccggcgagaaatcgagcgcagcgccggtgggctggcactgctgggggacccagtacaccctccgcagctgctggcccgggtgctaagccagtcattgcccggggctggcagggccagccggctgctccgagtgtggggcctgccaagcccacgcccacccagaactccagctggcccgcaagcgcagcgcacagcgccggttcccgctggcgcctctccctccacacctgcctgcaagctgagggagccggctccggccttggccagcccagaaaggggctcccacagtgcagcggtgcgctgaagggctcctcaagtgcggccaaagtgggagcccaggcagaggaggcactgagagcgagcgagggctgtgaggactgccagcatgctgtcacctctcactgacaccaggccagatcctacattcccaggctccaggtctgctccccagtctcaatctccaagccaaccctaacatccctatgctccagtctgacccaacctctagctggcccccatgcctcaggctttgagctcactatagtgccaggccagccctcacagatcaggctccaggcctaccctgaagattccatcttcaggtttactccagggtcagaccagtcccagtggtctcaggctctggatgccccccaacccagcatcaggctgggccccatagcatcaggcttcatgcctatctcagaactaggccaacccctacagccttaatcatcaggccagcactcagccttcaggctggcctgcagatataggttccaggcctgcccaggataaggctagctcctgcagctccaagctacaggcccgcgctagtttaaggtcagcccaaagccacatcagcccacacagcctgatgccttaggcccatctcagtgccaggtcagtacatctcaggcacaaggctgataccacagacacaggtttcagtcctgcctagtgccaggctgatccctgtggccccacactccaggctggcccctgcagtcccatgttccagcagatgtaagggccagatttgtcccagctgacctcagtgctaagctgaccctcatggacctaggttccaggactactcctaaatacccaggttctaggccagcccccatagacccaaaactccatgaactcaggatacaggtctaccccagtgtcaggtcagtccccatggacacaggctctgggcttatcctagtggacccagtctccgacccattccagggcctagccagcccctacagactcaggcttaaggctcaccctagtttcagatcagctactatggaaccaggcttcaggccacccccaatggatataggctctagatctgcccttggacctaggctccaggctcacctctgcagacccaatcaatacatctacctcagtggatccaggatccaagctcaatcttatgaacccaggcaccaggtcttcccacttgctaacccaggcacaaggcccactcacccaaggacaccagcagcaagtacgccaacaggccacgctagatggactgcccagaatctctggacatgctgactggtgaaggatttcccaaacaaacctagtttgcaaagactggaataagtctccacttcttaaaataagcagacaccagcaaatggccacaaagatcaagaataatcagagaaacatgtcatcaccaatggaagaaaataaaacatgagtaactgacactaaagaaatggagatatataaactgcctgataaataattcaaaataatagttgtatagcaaacttcaataaaatacagagaaataattcattgaaatcaagaaaacaataaatgaccaaaacaagaaatttaacagagattgaaattatgaaaaagtaaccaaattctggagctgaaaaatacaatgaattaaattataaaatgcaatagagagcattgacagcagaattgataaacagaagaaagaacctccaaactcaaagacaattatttgaaaatatgcaacaagaagagaaaaaggaaaaaagaatgaaaaggaatgatgaaagcttatgggatttatggaacagtatcaaaaaagcaaatgttcaagttataggagttaaagtagaagaaagagagagagaaatttatgtttatttaaagaaataataacagaaaataaattaaatctgagaaagaaatatccaggtacaggaaggtcaaaggactctgattagactcaagccaaacaagactgcaagacatattacaatcaaactgtcaaaaatcaaaaataaaaagaagacactgaaaacaggaagaggaaagaagcaaatcatctataaaggaattcctaaaagtctatcagtggattcctcagcagaaacactgcaggccaagaaatattgggataatatattaaaagtgctgaagggaaaaaaaaaaccctatcaaccaaaaatactatacccagcaaagctgtccttcagaaataaaagaatgatgaaaacttttccaggtaaacaaaagctgagtgagttcattccacatgatctgtcttacaggaaatgctaaagggaattcttcatgcagagcaaaaaggatgctaattattaatagtaacacaacatatgaaagaataaagcttactggtaaaattaagtacacagtcaaattcagaacactataaaactgtgatggtggtatgtaaatcacttatatctttagtatgaatgttaaaaaacaagtattaaaaataataatagtcacaataatttttaagggatatacagtataaaaaatgtaaattgtgacctcaaaaacagaatgtgggagtggataaagtaaaagtgtagttattttatgtagttaacattaacttcttattagcttaaaattgcctgttatgactataagatgttttatgtaagcctcttggtagccacaaagcaaaaaattatagtagatacataaaagataaaaaggaatcaaagcataccattggagaaaatcatctaatcacaaaagaagacatcaagggagaaaaaagaaacaaaggatctataaaacaaccagaaaacaattaataaaatggaagtagtaagtttttacctatcgttaattaccttgaatgtaaatggagtaaattacccaatcaaaagacatagagtggctgaatggataagaaaagaagaccaaatatacacaccctacaagaaactcacttcacctgtaaggacacacatgaattgaaagtaaagggatggaaaaaaatattccatgcgaatggaagccaaaagagagtgagagtagctatacttatatcagataaaatagactttaagtcaaaagctgtaaaaggagacaatgaaagtcaatatacaataataaaagggtcatcaaatatgtaacaattgtaaatatgtatgttccaacattggagcacctaaatatataaggcaaatatattaataaatctgaagagagagatggattgcaatacagtaatagcaggggacttaaataccctactttcaacaatggatagatcatccaggcagaaaatcaataaggaaacattgaacttgaactacactttagaccaaatggacctaatagatgtttatagaatattccgtacaatagcagcagaacacacattcttctcaagtgcattgcaatattctccaggatagatcatatgtttggctataaaacatgtcttagcaaatttaagaggatagaagcatatcaagtagcttttccaatgacaatggtatgaaactagaaatcagtaagagaagaaatttcagaaaattcacaaatatgtggaaattaagcaacatgcttctaaataaccaattggtcaaagaagaaattaaaatagaaattgaaaaatatctcgagacaaatgaaaatggacatgcaatataccaaaatttatagatacagcaaaagcagttcaaagagggacttttatggcaataaatgcctacatcaaaaaagaagaaatacataacctaatgttacacctcaaggaactacaaagaaaaagaataaaccaatcccaaaattagtaaaaggaaggaaatgatcagatcagaaataaatgaaatagagactagaaaacaatggaaaagataaactaagagctggttttttgcaaacagaaaagaaactaacaaaccattagctagactagctaagataaaaagactcaaataaatagaattaggaataaaagaggagacattacaattgatattataccatagaaatacacagtatcataagagactgctatgtgcaattatatgcctacaaatggtataacctagaaaaaattgataattattggacatatataacctattaagactaaatcttgaggaaatagaaaatctgaacagaataatgagtaaggagattgaatcagtaataaaaagtcttccattaaagaaaagcccaaaacctgatggcttcattgctgaattttacttaacatttatagaagaactaataacaatccttttcaaactcgtccaaaaaattaaatagaagggtgctatggtctgaatgttggcttccctgaaaatttatacctttaaatgtaatcccaatgtgatagtattaagaggtagggcctttggggacgtggttaagtcatgagggctctgctcttgtgagtggaagtagtgcccttataaaagagatgaagggatcatgtttgccccttctgccatatgagaatgtgacaaaaggcaccatctttaaagcagagcaagttcttaccagacatcaagtctgctgacatcttgattttggacttcctagcatccagaactataagcaatacatttctattgtttattaatcacccagtctaaggtattttgctataggagcctgaacagactatgacagagggacaacttccagagtcattttacaaggccagcaataccctgataccaaagtcagacaagaccaccacgagaaaaaaagttacaagccaatatccctgctgagcatagttataaaagttctcaacaaaatactggcaaactgaattcagcagcatgttaaaaggatcattaatcactttgggaggccaaagctggtggatcacccgaggtcaggagtttgagaccagactggccaacatgttaaaaccctgtctctactaaaaatacaaaaaagtagctgggcgtggtggcccatgcctgtactcccagctacttgggaggctgaggcagaagaatcacttgaacctgggagagggaggttgcagtgagccaagatcgcgccactgcactccagcctgggtgacagagcaagactctatctcaaataaataaataaataaaaggatcatttaccatgataaagtgggatttatccctgggatgcaggaagggttcaacatatatgaatcaataacagatgaaggataaaaaccataatgatcaactcaatagatgcagaaaaggaatttgacaaaattcaatatcgctttatgataaaaaacattcaacaaattagaaatagaaggaatgtacctcaatacaataaagatcatatacaataatcctgtagataacatattcaatggtgagaagttgaaagctttttctctaagatcaggactaagacagggatgcccactctcaccacttttattcaatatggtactagaagtcctagtcagagcaactaggcaagaaaaagaaataaaatgtatccaaattgggaaaaaataagttaaattgtctctgtttacatgtgatatgatcttatataaagaaaaccttgaagactactaaaaactgttagaactagtaaacaaattcagtaaagttgcaggatacaaaatcaacatacaaaagtcagcaggtttctatacactaataacaaactattcaaaaaaagaaatcaagaaaacaatcccatttacaatagctagaaaagataaaatactttggaataaatttaactaaggaggtgaaatacctgtacactgaaaattatataacattgatgaaagaaacagaagaaaacacaaataaatgaaaagatattctgtgttcatggattggaagaattaatattattaattctatactgcctgctagagtttgagtgtttgtctcctccaaatctcatgttgaaatttaatccccaaagatggaggtggggcctaatgggaggtgtttgggtcatgagggtagatccctcaggaatagattaatgccctccctatggggatataagatcatgttataggcaaacagtgagtgcattctcactctgttagttcccataagagctaattgtgaaaaagaggctgtcgcctcctgcctctctctcttgcttcctctcttgccatgtgatctctgcacacactggctcctcttcaccttcaaccatgaatgaaagcatccggatgccctcatcagaagcagatgttatcactatgcttcttgtacagcctgcagaactatgagccaaataaacctcttttcttcataaattaccagcctcaggtattcctttatagcaacacaaatggatgaagacaccacccaaagcaatccacagattcagtgcaatctctattaaaattttaatgacatttttcacagaaataggaaaaaaacctaaaatgtatatggaaccataaaagaccccaagaccccaagaccccaaatagccaaaccaattctgagcaaaacgaacaaagccagaggcatcacactacttgctttgaaaatttactaccaaactagaagaatcaaaagtgtattgtgctggtataaaaacagacacatagaccaatgaaatggaatagagagctcaaaaataaatccatgcatttatagtcaattgatttttgacaaagttgccaagaacacaaaatggagaaagaatatcttcttcaataaatggtgctagggaaactggatatccacatgcagaagaataaaattagaccctcatctcacaccatatatttatacaaaattaactcaaaatgaattaaaatcttaaatgtaaaacttgagactgtaaaatcagcagaccaaaatctccatgacattggtctgggcaaagattattttgatatgaccccaaaagcaaaagcaacaaaagtgaaagtagacagatgaaattacatcaaactaaaaaacttctacatagcaaaggaaacaatcaacagagtgaagagacaacatatagaatgacagaatatatttgcaagccatacatccaataagaggtacaaaatataaaatataaaagcaacaaatacaaagcaaaaaaaatacaaaaaaatacaaaatataaaagcaactcaaacaactcaatagtaagaaaacaaataacccaaataaaaaatgggcaagggacctgaatagacatttttcaaaggaagacatatagatatccaatagtatatgaaaaaatgctcaataacaccaatcaggctgggcgttgtggctcacgcctgtaatcccaacactttgggagtctgaggtgggtggatcacaagtcaggagcttgagaccagtgtggccaatacggtgaaaccccgtctctactaaaaatacaaaaattagctgggtgtggtggcgggcacctgtagtcccagctactcgggagactgaagcagaagaatcccttgaacccaggaggcagaggttgcagtgagccaagatcacaccactgcactccagcctgggtgacagaccgagacctcgtctcaaaacaaaaaacaaaaaacaaaaaccactaatcaccagggaaacgcaaatcaaaaccacaatgagatatatcacacttgttagaatgactactatcaaaaaagatgaaagataagtgttgaggatgtgaagaaaaggaaacccttgtacactgttggtgggcatgtaaattggtacagccattacagaaagcagtatgaagcttcctcaaaaaattaaaaattggactacagtaccatatgatcctgcaatcccactcctgggtctatatccaaaagaaataaaatctgtatgttgaagggacacctacaatcccatgttcactgtagcattattcacaatgttcaagatatggaacaacctaagtgtccatcaaaggatgactggataaagaaaatgtgttatatgtacataatggaatactaatcagccttagaaaataaaaaaaaatcctctcatttatgacaacatggatgaacttggaggacattttgttaagtgaaataagtcaggcacagaatgacaaataccacataatctcgtatgtggagtatttaaaaactcaaacttagccagtggttaagtggcacatgcctgtagtccatctactccaggggctgaggcaggatgattgcttaagtccaggagttctgggctgtagtgtgctatgccaatagggtgtctgcactaagttcagcatcagtagtaggtgacctttttgagagcaggggaccgctaggttttctaaggaggggtgaaccagcccaggtcagaaatggagcaggtcaaatatcccatgcttatcagtggtaggataagcactccagcctgggcaacatagtgagaccccatctctttaaaaaaaaaaaaacaaaaaacctcaaacttaacagaaataaggaataaagtggtacttaccagaggctgagggatgggaggattggggagatattagtcaaatgacacaaaatttcaggtagacaggaggagtaagttcagaagatatattgttcactttgttgactatagttaatgacaatatattatatatttgaaaattgctgagagtagattttaaatattctcaccataaaaaaagtatcttagattatagatatttagatgatggttaattagcttgatttatccatttcacaatgtatacacatattaaaacatcatgttgttgtataccacaaatacatacaatttttactggtcaattaaagtaaagaaataaataattacaagtattgaatacttagttttactgatctcaagtactgaaaatatgtcaatacaaaacatactgaaataccaaaatacactgaaattatactccagtatttaaatgacccttcagtttggtactggaggccctttaaatcagcttcccgtctacattttccactatttccatcccagagatagatgtttttctctatgtgtccttttccaaatagaccttggatctggctacctcgattccttttatcaagacccattttcctatttctatctgtaatgtttatatgaaacaaacacaactggtagaatggaatcttaaagcaaattcatttttgactgtctctttacatctccactgaggggctgttctccttgaccctaggaaaaaacagaggtggcccctcagagatattaaaggtactcagccatttttaaagtcacaaaacatggtggaaatcaggaattaaaatggcagtcataggtaagaatgataattcttaaccttgaagtttctcctcctctcctccagtttgtactggccacaggctagaagtctgaaatttgaaagtgggttaggggataatctcatgattcttctccttttaccatctttctaaagctgattctgaccactctaggatctggagcttaggaagggagatcaatgaaggagtactagcaaagttcttagttgactggtgctgtgcaggtgatcaagttggtgctctctggcctttgcagatgtttaaagctgattgctcttttaagggattttcatgggttgctctgagactcttccttttccccacctttctgcagccttaggtatccagcagcagttcatctccagctttcctgtattgaggctcctcactcctgcaggaggtcattataaacacgggctaagcaacaccacacaactccctttccctcatgggccacatctggtccataggaaacatgtttgtccaggaaaactctgggaatgcagccccttccccataactcagcactctggatttagatttctcaagcatgaaccagtcagaagtcccctgtgtccctcaaactttagaagacacatattaagctccacggatggttccataaaagttctgtcctttggtttgatttaaggagcagatatccctccttcccacccccaccctctttctccccctttctcctctcctctcctgtcctttcctctcttcttctctcccctttttcccccataatgagaaggatagaattcttggaacccaatacttccctccacagaaatccttttcaaaagtcttcctgatctccaattcagcatccctttacgccatcagtgtgggtaatcatttaagagttaccaacccagggctaggcacggtggctcacacctgtaatcccagcactttggggggtcgaggctggcagatcatggggtcaagagatcgagaccatcctggccaacatggtgaaaccccgtctctactgaaaatacaaaaattagccaggtgtggtggcacgcgcctgtagtctcagctacttggaagctgaggcaggagaatcgcttgaacccaggagaaggaggttgcatggagctgagaccacgccactacactccagtctgatgacagagagagactccatctcaaagaaaaaaataataaaaaaagagttaccaacccttccacccctttttaccacctactttgaaagtgtttgcattttggtccaacacatagctctagaatgtgccttagctgaagctttccttttaacatcttgttacatccctaaagctcacttttatacaactatcttttaaaaaaatcttccccatcacactcaggtagtaatttttacttctttgaactattaggtgtcgatcattatgccgtttacatagcacttattttcttccttgctttgtaggtatttaagtctacttatttttgtcaaaaatatataagttcctcaaaggtagagactatgcctctttcatttttatatcacaaaaaacttacacacagtttatatgtactatttattatatttataaatggattgctcagtattactgcagattgtaaaagtcttggaaaatatcttcaattcaacatatatttattgaatatgtgctgaatttcaagcactgtgcccagttgaggatacggacatggacaagacataatcctgcttctgaagagcttactattatcagaggaggctggcatacatgaaaaattgcattagtccacaataaaagtgtgctctaaaggttgtgcacaggagggactggttagttctaaccatgaggctcagggacatcttcatgaagttggatctgtctgaattgttttgtatgttaaatgagctaaagttcatgtaccataaaattcacccttttgaagactacaattcactgatttttagtatgttcacaaaattgcacaatcatcaccactatctaattccagaactcatttgttaccccaagcccatttgcactcactcttcattcttccctcccctgaacccctagcaaccagtaagctactttctgtcgctatggattccctaattctaggcatttcatataaatggaatcatccgatatatgcattttgtgtctgacttctttcatttagcataatgtttttaagctttatttgtgttgtagcatgaatcagtgcttcatttttatgacagagtaatattccacagtataatatatattttatttatccatttatctgttgatagacgttgtgaataatgtgctatgtgaataatgctattcacgtaacacactattctatgctattcacatagcattcacatagcattatataatgctatgtgaataaaggctattatgaacaatgctgctatgaacatctgtgtacaagtcttttaggaacatgttttcagttctcttgggtacatacctaggagtagaattggcaggtcatatggtactgaattgatttttgagggatccatagtttgctggtaactagactaataagagaaaatggcaacattattacatcaagacactcagactctcagtccaagtatttctaggttcaggagccctctctaccttcctgtcagatgttattttagtaccttgtggttttaaatccatgaaatcactctacctctttggtaggaaatatgactttttccttaatgaaatactctttctgcaactatggctcattcaaggtgagatgtggtgattttaaggatccaatccactgttactcatctaaccccacagtcactgcttcatggacaagcccagagcttttggcaggataaaccaatgggacattggtcttggaaaggctagttctccctgagccctagaaacagctgtgttatagctatgtgctcaggatcccttaaattacctggaaagcaatccatatccctcctccaactgcagagcttagtttattaaactatttttcaaataattacaagcgacatactttgatatgattttttaactaacattatattgtttgttataggggaagatttttttttccccaaaggaggaagtgggtagaattggtggaaaaaacaaactaaaataaactaatgcctaatttctcaagcccctttcagaggctaatttatataggagtgctaaatgagcccactctcctgcaatcctaaaacaggacaggctatatctgctcataggtattcttttcctaggcaatgttagtgtatgtgcatactaattttcgagacccagctcattttcgaggccacctttcctgagaaatgcctttcctggtcccataggcagagtgacagacttccatttactacactccaatcctttaggtgctgtcttggtctcctttaggttggtattacagaatgccacatactggttaatttataaagacagggaatttatttctcacagttgtgtaggctgggaagtccagtatcaagacactggcatctgggaagagcctttgtgctgcatcatcccctggtggaaggctgaagggcaagagagagcaggagaggaaagttcctttatatcaggaacctactcctaatgacattaatctgtcagttagagcaaagcactcatgacttaatcacctcttaaagatctcacctctcaacatagttcaactggggattaagttgcaatatgtgaactttgaatgatacattcaaaccatggcaggtgatcgtctctaataaactttattttgtgtttgattccatttgtctgtttgtgttcaccgttcttttcatcagtgctttgctcatagtaagcactaaataagtgttcaatttaattattctgaagtgatgaccctatactggtagagtgttagtctgccagcacatcatgccagtttcagcttcgtgaaagaaggaactcactacccagggaagcacaatgctttgctaggtttatgctcatactctgagtttgcacaatgcaggtaagacacacaattcccaattttgtgttctcgtccagcaaaatttgttgggcatttaccgtgttctgggtgggattcagaggtgaataggacagagtacaatgtgccaggctgctgtataattattacatttacttcctccagtaacaaagaaaggtaagtgtgttagtcaggatttttctggttgcaaaagataaaaagacaacttaatgacataaaacaaacaaaaaatcaaatgtattggctcatatatccaaaatatacagatgtggacttcaggtgctgctggatccaggaactagatgatcctatcttgatgctatctcactctccatctcttggctctatttttcctgtgtcttctttattctctggtaggctttcccttcatagtcattagtggctcccagtacctccacaattaccttctatcttgttggcagcccttgtcaaaagagaaaaattctttctagctgctccagcaaaagttttgggattacctctgttgaactttctcagatctcaagcccattcccaaaccaatggctgtgcccagagggaggaaatacactgattgactaaacctagatcatatgtcctctttacttttttaaaaaatttatttatatattttttgagacggagtctgtcaccaggctggagtgcagtggcgtgatcttggctcactgcaacctctgcctcccgggttcaagtgattctcctgccgcagcctcctgagtagctgagattacaggtgcacaccaccacacctggctaatttttgtatttttagtagagacagggtttcaatatgttggttatgctgatcttgaacttctgacctcgtgatccactcaccttggcctcccaaagtgctgggattacaggcgtgagccactgtgcccagctgccctctttaatttctagagtggactcagacaattaaaccttatgggcgaagggtgaagaaagggtagctctctagggtgatttggcatcctattatgtgaaaggaaaatggatactggacagacagagaccattctgatagttataataaactccactttagagataaggaaattatggcttgggaagttggcatatgttactcaaattctcattgctaacatgtattagtagagagaggactaggactcatgtctgtctgatttcaaattctgggtaacatgccatgtagcccatgctttcaaagagcttatacaccaatggccttacagccttgccagtcagtgggaatcacttaaaaaaaattgtggtaaaatatacataacatcaaatttaccattttaaccattttggaaagtaaagtttagtgatattaaatacctccaccatgctgtgcaactggcaccaccatccatctccagaaatttccatcatatcaaacaagaaccaccgactccttcctccctcagaccctggaagccgcctttctgtgttctgtctttatgagtttgactactctaggtatctcatataagtgcaatcatataatatttgtccttttgtgtttagattatttcatgtagcagaatgtcttcaagtttcatccatgctgtagcatgtatcagaatttatttcccttttaaggcagaataatattctgctgtgtgtacatatcacattttgttgatggacatttgggatttttttcctatcttttggctgttgtaagtaatgttgccatgaacatgggtgtacaaatgactgagttcttgttttctattcttttgggtacatacccagaagtgggattgctggatcatgtggtaattctatgtttaactttttaaaggagcaaccataatgttttccacagtggctacaccatttcacattcccaccagcaatgcacaaggcctccagttattctacgtccttgtcaacacttgttattttctgtttttttttttttttttttttaataacagccatcctaatgggtatgatgtggtatctcgttggctttgattagctattttcctaatgattagcgatgctgagcttcttttcatgtgatttttggccatttgtatatcttttttggagaaatgtctattcaagtcccttgcccagtgttgaattgggttgtgtgagtgttttgttgttgagttgcaggagctctttatatagtccaggtatcaatctcttatcaagtactttatatatgacttgcaaatatttctgccattctgtgagttgccttttcactctgttaaaatagtgtcctttgagacacaagtttttaattttgaagttcaattcaccatttttttcttctgttgccggtgcttttggtgttatatccagaaattacttttgaaaagcaaaaaggacatgtttaaaagaatagcacatggtcgttagtcatagaacatgtatgcataaatgtattggtcattttctaatttcagccagttgaagtttagttgtagaaaagagagtgagctacctgaaggagcatttggggtaggatgctacaatgagcaaagagacttttaccaatattagagcaataactgtctgacagggaaagggagaagagttgctaggagggggagagtgatatgttgagaagaagcagcacaaatgttacgtgtttcacaattttaactacactgatgaaatggtcttactgaagtgtggtgaaagcaaatgtcattaaaaatctgtacagtactttaaaaaaatagccttcagactccttggttcagtactgtgaattagggaagcatgccatacatgaaagcattataaaagtgctacgtaagattatattattattgctaatgtgtttgttcaacaaataagcatatgaaattggagcacaagaacacggacctaggagggaggtaacagacatggaaaggccccactcagatctccttcccaggaaagacttatagccccagctgtggggagtgtaatgagcacacgtcctctagctgtagctccctcagatttggtctcatcacagaaagcacttcacctcaggtcatgaccttttgagtgtatttggtgtctaagtgaggtgagaatataaaagccaggccattttgacccaatgtaggacacccttgttggtagtgtttgttctaaagctccctcaggtctgtactgcagtttaacttcttcctctgcttaatcctccctctgccttcttcctttcacaggtgttgatcctgaataaacatcttacacccaaacttcaactcaatatctgcctccaaagaacccaacctgtgacaagtgattttagagattacctaacccaaactctttctgaaataataaagtttattttttccaaattcaaaattattcttcttttagaatgaggtgattattcaagtagaaagaaaaacatcgctaacaatgttggcagccatctttggagaccacttgccgtaactgtaagtaatggttttaatctttgggtgtatcataatatacttatcccttgaacaattaatactttttctagtagttttttctagtttttcactagtttaagtagtgctacaataaatatctttgtgcaataaaggtttttatgtattctaaattattttcttaggatagattcccaggtgtagaattctggtttgcagagtatgatttttttttttttttttttttttttgagacggagtcttgctctgttgctcaggctggagtgcagtggtgcgatctcggctcactgcaagctccacctcccaggttcgtgccattctcctgcctcagcctcccgagtagctgggactacaggtgcccgccaccatgccctgctaattttttgtatttttagtagagacggggtttcaccatattagccaggatggtctcgatctcctgacctcatgatccgcccacctcagcctcccaaagtactgggattacaggcatgagccactgcacccggcccagaatttgatttttgttgttgttgttgttgagacggtctcactctgacacccaggctggggtgcagtaacatgatcatagctcactgcagcctcatattccttggcttaagcaatcctcctgcctgagtctcccaagtagttgggactacagacacatgccaccatgcctggctaatttttttttctttttctagaggcagagtcttgctatgttgcccagactggtctcaaactcctgggctcaagcaattctcctgcctcagcctcccaaagtgttgagattacaggcatgagtaactgtgcccacccaggtatgccattttcagtgctcttgatggatagttttccaaaggcttgaatcagtttttactgtcaacagagtacagcagggcatcaggaagcccatttcaatacatttttctatcattttatagaagagataattactggttaaatattaatttgtgacagtgttgagtcttttgcttcttaggtgagattaattccctttggtccatatgtgtagaaaacctgaaactgtaaagtgtaaagctcttctcatcagcttaccagtattccttactctcaggcatggaatgccaacccccaaaggatgcttttgtgaggacaaaagtgagcaggtggtgacggtaaaagatacagagattcctccctggagagcaatagaaatcaggaggcagtggtctcgatgaaaaccagcagaagtgaatagggacccatgtactagttgaatccatgtatttccaacatggtgcgacgtgtatgtggtagcagtggacccaaacaccacagaaaacttggggcagccacacaatggtgttatttcagtctataacaatgttccataaccacctttttttttacttaatatgtcatacattttccatgttattaaatgtctatgtgtgatttaaatcatttatattatgttaaataaagcatatagattctgagataagtactaatactttcattttaaagatgggcaaactgatgtgcagaaagtttaaaaacgtctaccattcccacaactagtaagtgaggggctcatattgaaatccagtcggggctgactccaaaagccaggattttctcactacactatgttgatcctcagggcataaaaaaaccaggcccagcacataccctctacttttgatatctggcagaaggcctggggagcgaggtgtctgtatgagaaagcagagtggtcgaaatacagcccctaccaccatcttcttgaaatcgttctattattttgcagttaacaagctgatggcaatttaaattcagttcaggtgtttaaatactagacactgggaacacacagataaacagggatgccagtttaaacagctgtatctgcttcaacacatttcagaagcaggagcaacagggagaccaaattaaggcctggcaccttgtgtgctagagacagattctcagagtgagcccgtggagcccaccacactcataccccaccgctagttctgccgtgtgcactgcttctgccacagaaatgtagcctaatttgaatggcaccgtctgttagactcctcttgataccaaaggaaggcttctctctgtcttttagtgatgaagacaccagttgccccgcttctcttttctttcctttttttccccccaattggcatcatttgctaagcccctctaagtacccaattcaggcaggacattagaatttgcctctcagaaaggatgcctctgactccctctagagggcacttgctgccagttatgggctaagtgccattgctgggaggattctgtgatcagccggctgtcagattcacggaaggctcctggtgcttgttggttggtttgttctagagaaacagttggagagtgtttccttgggcagctgggagaggtggggggactccctgcccacctcaatctcctcaacacccctccatccctcccctccctgactgggccttcactcagcaggcccttctagagggcggaggccaaagggtgtcacccgctttcatgaacaatgctgcctggagcctgtggtgtttagaggagtagatttaaccacagagggtttgtgggaactcctagttcagaacacaagggaggagagaacagaacattgagatgcaaagatttatgagggagaaagactcatgtaagaaaaggaaattagaaaccaagcaagcagaatattccaaagacagccacataccacgcataataatgaagtttccatgactctctttggctcagataggtctgcttaataattaatatggcaactctccctctctctgcaaacaggtggctgtacagggcttggcaaatatttccttattgctccctttactttctccgagaggaaggttgggtggtccagaggatttcccagatggagcagcaggcttcccatgcctgccatttgcataaggtaacagagtgagacaagagcagttctgggactggcaggcagagttccttagtgccatgcgcacagtggcaagatccctcaggcacctcaggagagtgggatcaaggccgagagggtaggcgaatgtcggtacatgaatggattttgaaatggaggcagcacttgtcatgtgccagcttcctttggaaaatgatgctacagagatcccatcactggttgggtcttgtccagctgctttgtggagggaaggatgaacaggacatgctctcctttgtgccaccaccccagtcaggtttgttcctctccatctctggactcgttgttagtcttccctggcttcaccttctcctcttcagtctagactgtacatactgctgccagaaatatcttcccaaaatactgcttctgccatgtccctccccagatagaaaacctatggaggaagtcacaaacaagtcatatcagtcctgtagatatgctttgtttcaagtatgtgatgttttaagaaatattttgaatttgtttccaacacggaaaaaaggaaaatcttagataaaaatctgaatttctggcttttggtggggggagaactaggtgatctggcaattctatacctgtatttccacattgcagttgactggagtgaagtagcaactgctgccttcagacagggcactgatgatgttgagcatcttttcatgcacttattagtcattcatatatcttctttggtgaaatatctgttcaaatcttttgtctattttttaaaaaatgaattatttgtcttcttatcattgagttatcagagctctccttcactttttactagataattcttctttactccaattctctgttatggtgaataattccttatattacactttccctgctcatattactatgtggtatctctctttattggattccaatttatacacatggctactaatatttatactctgttaagccagcaagaaatgctcagaacgtaagtaagaaaaagaaagtgtttgagctagacagatttgcgtttggatcccagttttgtcacctctatgtggctatagacaaggcatttcatctttctgaacttgcctgttattacctttaaaatatgaaaataatggccacctcgcaggattttcttaaagattagagataatatacgaaagtagcttatcacagagattggcagttagtaacaactcaaaaaatgatagccaaaaatagcagcagcaagtgaccaagagctgaaaataagtcttagggtttctacaggtgagagtaatattcatttaagctacatttgataacaaggtccttgttatttagcaaaaagtaccccttaagtggcacctgtgtgccactatagctaaagagatgccaaagagaagctggatgatgatggcccaggaaggtcctcatgccatgaccacgctttgggagctcatcataaatatgaagactggtcttcagcttcataggatccattttatcagtaccccaggagtgtccaagctttagaaggctgacgtatgtcaactaaactcacgtagttagtcttcaggataactggagtgactctcttttagggattgattcattattcagttgctgcctattatgaaagttaaaaaaaattacttattcttatattcaacccaactatttatggagacacaacctcaaactaaaatgatcaagttgctattgaaaaaaacataaattacaagataccacaggcactgtgatattactaaaatgcaatgacaataattatttagcttaccagctgatttggacattttatatatttaagttttgtgcatgattagaaccagaatcaggaatagacacaatgaaggtgtcatagagtggtaattcataggttttcaagtagtggcttgatctttgcctgaatggagtgggaaaactgccagctagaggcctgtaaacagcatctgcactcagatgaggatactggagtgtgttaagatccttctcttgttttgagacccttctgttctgagagagtcttgtaagtgatctctttggtcaggcagatgtaaggtaagaatccacttgtccttggggaaacctgctaagtattctatttggatctattatctggagtgtgacctcagatttaggacatttttttctacacatggatttgagctgtggtattctgagcattctatgtgtatgaaatgcataggggttttgctcaagcatttgcacactgaacgcaggaggcaaggttatggcaggtatgatgcacaggacttattgtctctttactgcacacaagataaaagactggagaggatgtggactgtttgttgtgccacatggttttatttagtacagaataggccatttttgttacagaatagggcctcactgtgccctgtaagagaatggaagacaatagatgctctacagagacagagaaatgaggtgggctttggactgaaaatgagggagatctttgggtctggtggaaattgagcctagattctgagcatggagatataatggcatttgtcagctactctctgttgtatgtctttgttccaagggcatttattacacacccagattagattcagattagccacatttggggagctaaggaacatggctatatgcatatttaaggcactacatgtagagggagttggtattcctggagttacaagacaacaagaggtgaaagcaggagcatggcacctcaatattctggggggcaagggctcggactgagatggcacgtgacaagcagagagggtttatggaaccggggaggttttctcagtgaccactggaggtacttgaggaggcgaacctgataaaaggcactttctgcagccctagaggatgcttgataggaatttagctattgttatttgtgtattaaaaggccagagaatttgagtacttctgtgctacataaatatacatattttaacaccataggtataacaagatcactgacactattagaagcagaagctcaattctaggacaatattatgaactggctttccaaatcattcctaataatgagtagcaacacagaaaagaccttttttcccctctattttccttccttttctcttgctgagcttggaaatctgggtgaggatcaaacagtccttgcttatggttcatatggggctctgctctctggagctcctcctaacagcatatcatgcttcatgactcctgcaaccgactagctctgatgctctgatctgacaggtttctattcttgatgtttgttttgctatgcattatacattaccccatgcttatgaagaactggccattctatctgacttaggccttcgtggtttccttggacttttagtagtctctgaccttctttaccttctcctttttttcttctttcctcctcttccttattctagaaaagattttccttcctgtaagggatagctttaaaaaaatttaaagtgcgtatacagatatagttaatcaagattaaattaaaggtagatgaataaaagaaaggaaaaacaaggacaaggaacaagggggatacaaaaatgtatccctaatgattccaactcttgattactggtgggccaccaattgatgccaagcttcccggagatcacttgaaaaggtgggagcttattaagtgcccaagccacaggggtcacgaggtgaaaaccagcaaaacaacttattcctaatattaaaaccagaaagaaaattatcttaagacacgccataaggaagatcttgtgtaatatcatgaaaagggtcttcagtaacaactctttactgtaggcactgggatggaactcattaggggtaactgcaccaaagctcaagaaaagcaattctctgctaggtgcagtggctcacacctgtaatcccagtactttgggaggccaaggtgggcagatcacttgaggtcaggagtttgagaccagcctggccaacgtggtgaagccctgtctctaccaaaaaatacaaaaattagccgggtgtggtggtatgcacctgtaatcccagctactgggaaagctgaggtgggagaattgcttgaacccgggaggtggaggttgcagttagtggagatcaagccactgtactccagcctgggcaacagagcaagaccctgtctcaaaaaaaaaaaaaaaaaagaaatttttttccttttttttttattatactttaaattctagggtacatgtgcacaacatgcaagtttttacataggtatacatgtgccatgttggtttgctgcacccattaactcgtcatttacgttaggtatttctcctaacgctatccctccccctgcccccaaccccacaacaggcccctgggtgtgatgctctccgccctgtgtccaagtcttctcattattcaattcccacctatgagtgagaacatgaggtgtttggttttctgtccttgtgacagtttgctcagaatgatgatttccagccacatccatgtccctgcaaaggacatggatgcatccttttttatggctgcatagtattccatggtgtatatgtgccacattttcttaatccagtctatcattgatggacatttgggttggttccaagtctttgatattgtgagtagtgctgcaataaacatacgtgtgcatgtgtctttatagcagcatgatttataatcctttgggtgtatacccaataatgagatcgctgggtcaagtgggatttctagttctagatccttgaggaatcaccacactgtcttccacagtggttgaactagtttacactcccaccaacagtgtaaaagcatccctatttctccaagtcctctccagcatctgctgtttcttgactttttaatgatcgccattctaactggtgtgaaatggtatttcattgtggttttgatttgcatttctctgatgaccgtgatgatgagcattttttcatctgtctgttggcagcataaatgtcttcttttgagaagtgtctgttcatatcctttgcccactttttgatggggttgtttgtttttttcttgtaaatttgtttaagttccttgtagattctggatattagccctttgtcagatggatagattgcaaagattttctcccatgctctaggttgcctgttcactctgatggtagtttcttttgctgtgcagaagctctttagttcaattagattccatttgtctattttgacttttgttgccattgcttttgttgttttagacatgaagtccttgcccatgcctatgtcctgaatggtattgcctaggttttcttctagggtttttatggttttaggtctaacatttaagtctttaatccatcttgaattaatttttgtataaggtttaaggaagggatccagtttcagctttctacatatggctagcccattttcccagcaccatttattaaatagggaatcctttccctatttcttgtttttgtcatgtttgtcaaagatcagacagttgtagatgtgtggtgtggtgttatttctgaggcctctgttctgttccattgatctatatctctgttttggtacgagtaccatgctgttttggttactgtagccttgaagtatagtttgaagtcaggtagcatgatgcctccagctttgttctttttgcttaggattgtcttggcaatgtgggctcttttttggttccatatgaactttaaagtagtttttcccaattctgtgaagaaagtcattggtagctttatggggatggcattgaatctataaattaccttgggcagtatgaccattttcatgatattgattcttcctatccatgagcctggaatgttcttccatttgtttgtgtcctcttttattttgttgagcagtggtttgtagttccccttgaatggttccttcacatcccctgtaagttggattcctaggtattttattctctttgtagcaactgtgaatgggagttcactcatgatttgactctctgtttgtctgttattggtgtataggaatgcttgtgatttttgcacattgattttgtatcctaagattttgctgaagttgcttatcagcttaaggagattttgggctgagacgatggggttttgtaaatatacaatcatgtcatctgcaaacaatttgggacaatttgacttcttcttttcctaattggatactctttatttctttctcttgtctgattgccctggccagaacttccaacactatgttgaataggagtggcgaaagagggcatccttgtcttgtgccagttttcaaaggaaatgcttccagtttttgcccaatcagtattatattggctgtggcttcatcataaatagctcttattattttgagatacattccatcaatacctagtttattgagagtttttagcatgaagggctgttgaattttgtcgaaggccttttctgcatctattaagataatcatgtggtttttgttgtttgttctgtttctgtgatggattatgtttattgatttgcatatgttgaaccagccttgcaccccagggaggaagccaacttgatcgtggtggataagcttttcgatgtgctgctggattcggtttgccagtattttattgaggattttcgcatcaatattcatcagggatattgttctaaaattctcttattttgttgtgtctctgccaggctttcgtatcaggatgatgctggcctcataaaatgagttagggaagattccctctttttctgttgattttccggaatagtttcagaaggaatggtaccagctcctctttgtacctctggtagaattcagctgtgaatctgtcaggtcctggactttttttggttggtaggctattaattattgcctcaatttcagagcctgttattagtctattcagagattcaacttcttcctgatttagtcttgggagggtgtatgtgtccaggaatttatccatttcttctacattttctagtttacttgcgtagaggtgtgtatagtttctctgatggtagtttgtattcctgtggcattggtggtgatatcccctttatcgttttttattgcatctatttgattcttttctcttttcttctttattagtcttgctagaagtctatcaattttgttgatcttttcaaaaaaccagctcctggattcattgattttttgaagtgtttttttgtgtctctgtctccttcagttctactctgatcttagttatttcttgctttctcctagcttttgaatttgtttgctcttacttctctagttcttttcattgtgattctaggatgttgattttagatctttcctgctttctcttgtgggcgtttagtgctataaattttcctctacacactgctttaaatgtgtcccagagattctggtacaatgtgtctttgttctcattagtttcaaagaacatctttatttctgccttcatttcactatttacccagtagtcattcaggagcaggttgttcagtttccatgtagttgtgtggttttgagtgagtttcttaatcctgagttctaatttgattgcactgtggactgagagacagtttgttgtgatttctgttcttttacatttgctgaggagttctttacttccaactatgtggtaaattttggaataagtgtgatgtggtgctgagaagaatgtttattctgttgatttgggatggagagttctgtagatgtctattaggtctgctttcctggatatccttgttaaccttctgtcttgttgatctgtctaatattgacagtggggtgttaaagtctcccattatgattgtgtgggagtctaagtctctttgtaggtctctaaggacttgctttatgaatgtgggtgctcctgtattgggtgcatatatatttaggatagttagctcttcttgttgaattgatccctttaccattatataatggctttctttgtctcttttgatctttgttggtttaaagtctgttttattggagactaagattgcaacccctgccattttttgttttccatttgcttggtagatcttcctccatccctttattttgagcctatgtgtgtctctgcacgtgagatgggtctcctgaatacagccaactgatgggtctttatccaattttccagtctgtgtcttttaattggggcatttagcccatttacatttaaggttaatattgttatgtgtgaaattgatcctgtcattatgatgttagttgcttattttgctcattagttgatgcagtttcttcctagcttcgatggtctttacaatttggcttgtttttgcagtggctggtaccagttgttcctttccatgtttagtgcttccttcaggagctcttgtaaggcaggactcgtgttgacaaattctctcagcatttgcttgtctgtaaaagattttatttcttcttcacgtatgaagcttagtttggctggatatgaaattctgggttaaaaattcttttctttaagaatgttgaatattggcccctgctctcttctggcttatagagtttctgctgagagatctgctgttatagagtttctgctgagagatctgctgttaatctgatgggcttccctttgtaggaaggggtggcctgcccctccacacctgtgggtatttctagtcgggtgggacaagagactgagaaaagaaataagacacagagacaaagtgtagagaaacaagagtgggtccaggggaccggcgctcagcatactaaggacctgcaccggcactggtctctgagttccctcagtttttattgataattattttcattatttcagcaaaaaggaatgtagtaggagagcagggtgatataaggagaaggtcagcaaaaaacatgtgagcaaaagaatctatgtcataattaagttcaagagaaggtactatgactggacgtgcacgtaagccagatttatgtttctctccacccaaacatctcagcggagtaaagaataacaaggcaacattgctgcaaacatgtctcacctcccaccatagggcggtttttctgctatctcagaattgaacaaatgtacaatcgggttttataccgagacattcagttcccaggcaggcaggagacagtggccttcctctatctcaactgcaagaggctttcctcttttactaatccacctcagcacagaccttttatgggtgtcgggctgggggacggtcaggtctttctcatcccacaaggccatatttcagactatcacatggggagaaaccttggacaataccccgctttcaagggcagaagtccctgtggctttccgcagtgcattgtgccctggtttattgagactagagaatggcgatgacttttaccaagcatactgcttgtaaacattttgctaacaaggcatgtcctgcatagccctagatcccttaaaccttgatttcatacaacacatgtttttgtgagttccagattggaacaaagtggttgggtcaaagtggctggggcaaagctacaaattaacaatatcttagcaaagcagttgttcaaagtacaggtctttttcaaaatggagtctcttatgtctttcctttctacatagacacagtaacagtctgatctctctttcttttccctacagtgggtaacctgacctttctctctggctgcccttaacattttttccttcatttcaaccttggagaatctgataattatgtgtcttggggttgctcttctcaaggagtatctttgtggtggtctctgtatttcctgaatttgaatgttggcctgccttgctaggttcgggaagttctactggattatatcctgaagagtgttttccaacttggttccgttctctccatcactttcaggtacacccatcaaatgtagatttggtcttttcacatagtcccatatttcttggaggctttgttcatttctttttactcttttttctctaaacttctcttctcactttatttcattaatttgatcttcaatcatagataccctttcttccacttgattgaatcagctattgaagcttgtgcatgcgtcatgtagttctcatgctatggttttcagctccatgaggtcatttaaaatcttctctacactgtttattctagttagccattcgtctaatcttttttcaaggatttagcttccctgcgatgggtttgaacatcctcctttagctcagagaagtttgttattaccaaccttctgaagcctacttctgtcagctcatcaaagtcattctccatccagctttgttccattgctggcgaggagctgcaaccctctggaggagaagaggtgctatggtttttagaattttcagcttttctgctctggtttctccccatctttgtggttttatctacctttggtctttgatgttggtgacctacagatggggttttggtgtggatgtcctttttgttgatgttggtgcttttcctttctgtttgttagttttccttctaacagtcacgtccctcagctgcaggtctattggagtttgctggaggtccactccagaccctgtctgcctgggtatcaccagcagaggctgcggaacagcaaatattgcagaacagcaaatattgctgcctgatccttcctctggaagcttcatcacagaagggcacccgcctgtatgaggtgtcagttggcccctactgggagggggtcaggctacacgggggtcaggggcccacttgatgaggcagtctgtccattctccgagctcaaccgctgtgctggagaaccactgctctcttcagagctctcagacagagacgtttaagtctgcagaagtttctgctgccttttgtacagctatgccctgccctcagaggtggagtctacagagacacaggccttgctgaactgtggtgggctctgcccagttcaagcttcctggccactttgtttacctactcaagcctcagcaatggcggatgcccctctccctgctgggctgctgcctcgcaggtggatctcagactgctgcactagcagtgagcaaggctgtgtgggtgtgggaccaccgagcctgggtaaccatagtgagacctcatctctacaaaaaataaattttaaaaaactggccaggtgtggcacacacctaaagtcctagctaattgggagtctgaggcaggaggattgcttgagcccagcagttcaaggctgcagtgagccaagattgcaccactgcactcaagcctgggtaacagagcaagaccctgtctctacagaaatgggtgggttctgtatctgtatcatgttttggagagtacatgagaaatcatatgtgaatcctctagcacagtgtgcctggcaaatgggaggcaatttataaatcttagttcttctccatccctctttcttcccttctcctttaacacaatatggtgtttatacttaaagacttgttaaatctggtgcagtacttatttcacatatgatttctctttataaagagactattgtcttcaactctttaagcctctcctctcaaattatagatcatagtgctttggacatagtaggaatgcagtacctatgggctgagtgattccaattggaatgtcatgaaaaggaggagtagaacagggtcctcatggcagtcacttaaagtcgtggcaggaccctgttcccaagggcccctcgtgccattctccaaaagctatttcccctgtcagagtaggactgagagagagacagagagagtgaaggtgacagaaagagagagagggaggggaagagagaagcaaggtagtgggtaggaggtagggggaagctggaacagtcttttttttctcctcactcaacttcagtaaataactcaaatattttaatagcctgattttctcagttctcttataatttaatttgagggctttggtaatgcacagtgttagtacaataaggattttttcttaaataaagagaagctttgtgtttgaatgaaaatcacatacagaaggaatctaattttttaagaaaatctctttgttgtagtacatttctcaaacattagtcaaacactccctctgccactttctccaccaacctcccccagtgccacctaaagagacttgaaaataactcatgatgtttagggaaaatcagcaggctatttaacttttcctagatgggtcataataaaaaaaaaaaagagagaaatagtctcccctcagtttatggaacaaaggggaggtagggagagcctaggatggaggagctaagtcagccttcctgtttagggagctcaagcatatcaaagcatgtcggagtatgcagggtaccccaccactggttctgtttgaataggggccttataagcctcaagggagacgagaccaattggagctaatgactgcctgctgtaataattgtagatagtaagagagatgccattttttaaaattatactttaagttctagggtacatgtgcacaacgtgcaggtttgttacatatgtatacatgtgccatgttattgtgctgcacccattaactcatcatttacattaggtatttctcctaatgctatccctcccccctccccccaccccacaacaggccctggtgtgtgatgttccccaccctgcatccaagtgttctcattattcaattcccacctacgagtgagaacatgcagtgtttggttttctgtccttgtggtcttttgctaaccatcattctgaaccgtcgttctgagagatgccttttaaagttccacactgaaacattttacctggaggaaagggatagacacatgtaccaattcaatttagggacactgggtataagtggaggaatgattttgaatataacattgagtgatgatatacaatatagtatgccctcctggaaaaacctcaagggattctctgtctttgctggttctgaccactttgggcacctttgaaccacttcaaaagttgtgtaaggtccatccaatccagatccctctctataagaaaagtatctttttaccttggaaccttatgaagatggctgaattaattaagaataattgagcccatattctggagttagaattttatatctttaccatatggctaagtcacacataaatgcatacacaaattataaaggatataaagtagacatgctaaagaactgataaaaatccttaggtctggcaagagaattaccagtgttctggtcaaattcataattctcttattctagttctatagattccctcctgtgtgccatgccattttttctaaacaacaggctatgctgaggtacgtttttcctctcctgggacttttattttctgtctttcttatgtactggctagaggttcattttatgcacagtttctatcagtatattgccaggaaaatctttgacttcctccaataagcaaagataaataatcagacaagaactgccatagcctcctaccgctacatctactctcctacaatatctgtcccatatactcttgcctttctgcttctaacacagatgaaccctctgtctcctctttaagtctgactcttctgcctctgtcttcaatcccatcccctttcacctactcaaggatattgcttagcaattttccttatctttgtctctttatcatctatcatcactgcatcgttctcattagcttgcccacatgctattatttctcccatctgaaaaataaatcttttcttgaccccactttcttctgtagctgcatctgatttctcttttctttacagcaaaactccttgaaagagtggctgccttcaattccttttttccattatgttgtaaacccactccaagcaggcgttcatctccttcatttcactgaaactacttttgtcaaggtcaacagtgacttctatggagctcaatccaatagccatttctcatgatcggccactgtccttcccctcttgaccttttcagactcatctctgacttttctccctcctttcttcactccagcacactgtccttactgttcctcaaatctgggcaggctgtctcctcagggctttgcactggctttttcctttgcctgggatgctttcccccggatatgggcatgcctagctcccagaccgctattaaatctctgctcatgtcaccttttaagtgaggaccactctgatcatccaatttaaaatttcaccccccacctcacctcgttgtcactcctggtcccttttgtattcattaactattgctgtataacatattaccctcaaacttaatagcttaaataacaacagacatttattatcttgcacagtttctgtgggttaggaattagggagtgctttagctgaatggttctggctcaggatctcctatcaggttatagtcacatgtcagccaggatagaggattggcttccaagatggcttattcacatggctgttggcagaaggcctcagttctccccacacagacctctcccaagaatgcttgagtgtgcctcatgacatggcagctggctttccccagaacaaacaatctaagacagctaggcagaagctgcaatatcttttataatctagccttggaagtcatacaccattacttctgccagatcctattgttctcacaggccagctccattaaatgtgggaagaaatacaaggtgtgtttccaggaggtgaggaactgggggccatcttggaggttggctactacatctttgcttgattttctccgtagtacttatcaccttctaatacattatacaagttacttatttaagattgtaaaccaaaaatatctgagacaggtctcaataaatttagaaagttttctttgccatggttaaggatgtgtgcctgggaggcagctctgtgcctttctctgaagatgaccttgagggcttccatatttaaaggggaaagggcagctattggggaaagaggaagaaaattcttaaaggtgtggataaataagagacaaacagttgtgtacttttgatttttgagcagcctttcaccgaatacaaaatttacacatgatgagggtgggggtagaaaaagagtctagctcagtaaatctgcatttttacatcagaggaagcaatcagatatgcatttgtctcaggtgagcagagcgatgacttagagttctgtccttcgtcctacctgtgaggataagctatcaatttacattgtcagggtaaaactcaacagaacccttttagggtaaagatcttgaggctcacaaggaatttcgtagtggtcaaatcatgaaggaggtatgtggcttttttatctttgtaactatcttatttaggaataaaatgggaggcaggtttgcctgatgcagttcccagcttgacttttccctttggcttagtgatcttgggatcctgagatttatttttccttcacaagatgtttatttttagtctccttgttcctggaaaggggtcccaatccagaccccaagagagggttcttggatctcactcaagaaagaattcgaggcaaatccatagagtaagatgaaagcaagtttattaagaaagtaaagaaatgaagaatggctactccataggcagaacagccccaagggctgctggttgcccatttttatggttatttcttgattatatgctaaacaagggatggattattcatgagttttctgggaaagggttgggcaattcctgtagctgagggttcctcctctttttagaccatatagggtaacttcttggtgttgccatggcatctgtaaactgtcatggcgctggtgggagtgtagcagtggactatcagaagtcactcttgtcacccttttgattttggtgggtttgggccggcttctttaatgcagcctgttttatcagcaaggtctttatgacctgtatcttgtgccgacctcctgtctcatcctgtgacttagaatgtcttaacctcctgggaatgcatcctagtagatctcagccctattttatccagggcctattcaagatggaattgctctggtttaaacacctctgacatcatcatgctaggtggttaagctcctcgagggcagtgattttgtctattttattgactgttctatgtttagtgtccagcacagtatttggcacatagcaagactcaaatatttgttaaataaataattgaatataaagctctgcaaaattctgtctaccttccctgattattaatctggagcagcttctatctcttaaattgcaaagagctgcagctccagtcaactattttcactgctctgagcattcagtgacccatatttgttttctgactcaatatatatagtgcatttgctggagtgaagaacttcctgattgaaatctgatcttgtaaggtacctggatgtgctctggtgaacagtaggctgaggcagacatccgggctagagtgactcatagagtttagggtgcaggcgcttactccacctgttatataacctgtttgtgtaagctcatacctggcttggagccactgttgtttgaaaaggtataattgtcctgctgatgctgtacacaggggacatggcttggctcagctcttgggcatggctcaacatggctcagcacactggcacccagagaaagagagagagagccaaagatgtctgtcttgcaggcaggcaggtgggagccaggaaccagcttttgcccagagaaagagttaagctgctgaccctgaaagcaagggagagtcagccgtgcagctctgcatggaagtggccggctcaagcagctgaaacagagcatacagtgtaagagagctgctgatgagagagctactgaataaagccatatttcacctacacatggccgcccgaagtgttctttcagctatccacccactcccctcagacctaagcatgggctggaccctgaccctggatctaacaattggtgacattggcaggatgaggtgtggtacccagtggcagtggtgctgcttggatgggccctagtggaaatgtgagaggcaatggacagggcccccatgagtatggggaaggccctgaagtacctggaggtgcacaacaccaaggaggaacatgcctttgccagcagagtcagatgggcgtttgtgactgtgctgcaggaagtgcacgcccaatccctgtgagacacagtgcagggaggaggaagaacttctgttgcaggcttgcccagtgatccgtctgaaaatagagcatggacagctgttgggccccaagggtgagcccagggaccctccccagttgtgatggaacacatttcctatagtcccggtgcccctactgagttgtgggagttaagcaagtaatgtcggcagtcatgtacagacttagtgcaagtcattcaggagaaggacgttgctgtgcaacccagtcccacccaagtgctccggttcaaaaaatacctgctgcagtcaggcaaaagtgtaaagccttttctgtttgataagagaactgaccaaagtgccaggatgggtacattcatgggtaacaaccccccggactgggaaagtggttagcaactgcatatgctgcccttcgggctcataagagtgtggcaggatgggctacagtcatcgtctggatgacttacccaatagtgggatgggtgcattcatgggtaactacccctgccagacaggaatggcacagacatccactttagtgaagtggggtgtctacttggaacagtggagtactctgagtacaagtcccttagcagtagaggttttagggcctgtagtcctaatgcaagatgaggccatggggcctgaggcacccctagaccctgagccatcactgtttaaggaagggtgccctcccattcctgatagggcatggtacatagctaggtctagccagggtgctactgctgtctggactgctggtgcagtccagcctagttctgacaccacatggtttgaaatcaggtgtagacagagtagctaatgagctgaactcagggcaatgtaaatggtaatcaccaaggaggtgacacctaaggtagtctgcaccaatagctgggcagtttatcagggcctatgtatgtaatgggcctgtgtgcccagaagcctatgtttatgtatcaggcctgtgtgtcaggcctgtgttcccaggcttatgtatcaagtctatgtgtgtatattgggcttgcatgcccaaagcctatgtgccaggcttatgtgtcaagcatatgtgtatgtatcgggcctgtgggccgaaagcttatgtgtcagacgtgtgaatcaggggcttatgtgccaaacccgtgtattggacctatgtgtctaaaatctatgtctccctcagcttagggggtggagtgtaaagtacatggatgtgctttggtcaacaatagactgaggtggacatctggaccagaatgactcagcaagtttagggtgcaggcgcatactccactttttatacaacctgtttgtgtaagttcgtacttgccttggagccactattgtttgaaaaggtataactgccctgctgatgctgtgcatggggaacatggatccgctcagcttctggacatagctcgacatacctcagcaaactggtgcccagagagagagagagagccaaagctgtctgtcttgcaagcaggcaggggacagccaggaaccagcttgtgcccagaggaaaaaagagttaagctactgaccctggaggcaaaggagagccggctacacagctgtgcatgggagtggctggctcaagcagctgaaacaaagcaaacaatgtaagagagctgctgatgagagagctactgaataaagctgtatttcacctacctatggcccccacaagtgttcttccagctatccacccagtccccttgcatgggctggaccctgaccctggacctaacagatctaaaaacaaatttccctcattggaaccaccaccaccaacacacacataaagttagagtcattttttgtttgtgtttttttggatcattttatgcccactgcagatactccagtatatacaaaaataatagtgtcagaggcgtttgagccagagcaactccattttgaataggggctgggtaaaataaggctgagacctactgggctgcagtcccaggaggttaaggcattcttagttacacaatgagataggaggttggcacaagatgtaggtcacaaagaccttgctgataaaacagtttgcggtaaagaagccggccaaaatccaccaaaaccaagatggtgatgagcgtgacctctggtcgtcctcattgctcattatatgctaattataatgcatcagcatgctaaaagacactcccaccagccccgtgagggtttacaaatactgtggcaatgtcaggaagttaccctctatggtctaaaaaggggaggaaccctcagttctgggaattgcccaccccttttctagaaaactcacgaaaaatttactttttgtttagcatataatcaagaagtaacaataagtataagcagctgagtggcccatgcttctgctctgcctatggagtatacattttttattcctttactttcttaataaacttgctatcactttactctatggacttgccctgaattctttcttgtgtgagatccaagaaccctctcttggggtctggatcgggacccatttctggtaacaacagggtctcacccacagtgtcttctggccctgccaggccctccagctaagcagggaattatactaagcaagaggagcaagtcagcgaaggagctctggggctagggcggctgtaagggctctaggggcacatggcggctctatgctgtggcctaagagaggcatttttaacatctgggtggtgaccctgctgccatcagagttcaggaattgctgagaggagaagcagcacctgttccctgggtctctgcagtggcagcagctgagatggtaataggtgtgctgatgcctgaggaagtggaatcccagctgagggagtggtcaagcgctggcagcagctgcgaagggcaggggcccagctggttaaggagagagccctggcttctccgccttcacagtaatcccttcacctgtgctcttgggcccatcctgacttttcctcacagtctcttgcttcaaccacttcccctactcatttcaggcttcctcctattccatggtctttctcccctcagcctgcaaatatgctttgctctccccttttctaaaaacctcttctgtctcctgggaccacttctcttaggtcttagccatccctcaaaaaaacaaacacacaaaaccatactcttctaccatttagtcctgtttccaaccaacagctatagttgcatttgtctttccttagcaaacatgttaaatgagctatccatatacctggccttcctcagcaacttacccatttatgaatttatgcaataggcaatgtattgaggacctactatgaataatagactgggaatagaggatagattacggtttcttccctcagaggagttctctgcctaatagaggacataaatgggttaaaaaatttacagtataatgtgataagtacaacaaagaagggaagtacagtgttcagaggtataataacacaaaagagagagtcatcgactagagagaagacaggcagagatcgaagatggtttcctgagggatgtggagtctgaactagatttcgaaggacaacaggaaaatgtaggggaaaacacagtttcttggaagctgaataagagatatcagtcaacttcatctactgccacagagagatgacataaaatgaggaaaacacacagataaattagcagcatggaggtcattatgggactttgccgataaatcaaaatagagaggattgcagtgggatgagaagcaaacaaggtgtgagaaggtagaggttttcgcagaagcctagctgagatgggagagcattgtaaggcagcagctagagagaagtgcagggtgggaggagaactgccaaggttgagagagagacataccagttgccagctccttagggatgtcacaaggaatcagtgagttaatacacgtggagtgcttacacaatgcccagcacacactccataggtggtgtggccagaatgcaaattctcatgcctgggtgctaatcccatgcttatttcattgcatcaggaaggcctggggggaaatttccacattcagagagttcttgggtaatggggagagatgagagagattgggtagtgccatttgaggccagtcagaggtcttatggctcattcaggagacacaaggctctgagcttcctatgttctgacagggtcaaagtttccctcaccaattctccccacatggcttcttagccagacttcttcaaagaggctgatcgcaaaccaccttacctcatgacagccccccagacatccctgcatgcctcccagcagaatatttcaggtgggcagcttagccatcaggggaggggactgcagctgctgaggacagctgagctccagtccttgctgttctattggctgcccagtgagtggagaaggtgatgggggtggggcgatgtccttagggaggagggttagaggaagctcccagatgggacaccaccacaggaggctgtgatcacactgactgaaggaagtagcaggtcccattcagtccctgacctggggacagtctcagaagggaacagtctcatgagtccaattttaaagaattgctgaattgtctgaaataatggatttggaatttttttccacttgggatagtaaattccaccaagagaggaaataacttataaatgattaacattggcataagttaatatttctgattgcaggaccttgtcaaatggaaggccgcgtaggatttggagaggggagaaagggaaaagagaaaaaatactctgagtaggggaccctgctaatgagagagcaagcctgttgggtggtaaggattgaagtggggatgatgggatgaaatctatgagggttcagggggctcctagaatcctaggaatatggaggatctgaggggaaagagaatacattggttgagaacataccatgtgccaggtactcagctaagcagagtagatacaatgagtaaatctaagtttctgacctttcagaatccacagtctgagactgaggggaaaaaggtacatttcagtagaaggtgtgaaccactatggtggttacaagcatggcactgaaccagcctgcttggatctgaatcccagttctgccacttattagttgtatggctttgggcgagagtcttaacctctctgtttccatttctccatctataaaatagggataatagtagtagctactcatagggttgttgtgaggaaagaatgagttaatacacatacaaagtgcctcaaccagtacctggaataaaataaacactattgtagggtcctccaacttcccccactttttctctggtcctgccgggaaacgtagaacacttgcaccactctcccagccagatatatgttttctcctgcaggcttgaacccaagtggggcccttgaacatttccaggcactgataaaggtgtttgcatttttgcccaaaaccctgaaagagactagccccagccccgagtcaaactccttaaaccctcttataagctccataccctgactttctcattgcagacatacctaggtaggacatcccttgtctcattgtccttcgggaggatgctctccagcccccctctgtaatacagttcacctgatacagtaaatgcttttaactaatcaccttgacattttagtacttctttctttggaatcccaactggccccatcctggaatcatttggggcagtcccttgcaggaactcctctgcccctgcttttgggtgactccagctgtgggttcagccacagaggctgacatcaggttttgtcacagaggcaggcatcaggtactatgggagaggtgaccagagaaatctcaagaggcaagtttgtcccctacacaaccgggaatttttctgtgcctttgcctttgtttccctttttctttcctaggtctctaccgaatcacttgcttcctcaccccgccccgcagggccagtgatgtgccatcacaagccagtgcagtaagtgcctgacactcccaatgcccctttgataaggaaggctctgcctccaggaaacagaagctgtctttatcttttattcctgtccagtgtgctttccttcagccatctccttttatcatccacattgtccacctgagccccagttctgaggtcctttccctgggacccttgaggttctcacacagtctgggcagtgggtgtcgctggtctccagcttttcctgctcttagcgatctgcagtagtctctttcctcctaggtgcagtgtgctctggttccctgagccatccagggatgttaggaagatcaggaaccaaagacaagttcagggaaggaaacagaatgtcttagggctcttcagaagccctaagagcacgagcctagagatatggatatggctcaccctgactgcctctagctcgtcaggtgacccagcacctcactccacctcagtttcctttcctagatgtaaagtgagagggttggatgaggtcagtagtttgcaaacttttctctaccatggaactcttttactatttctctttgcatggactttatgtttgaaaagatttgatcagctcaaaacaccctgccatttaataaattatttttccatttttttaaatttatttttattgtatatatttaaggtaaacaacatgatgttttgatgtacatatacatagtaaaatgattattacagtcaaacaaattaatacatccaccactctccatagttacccccatcctttttttgtggtaagagcccctaaaatctactctctcagtgaattttcagtacacagtacaataatgcattattactatagtcctcatgctgtacattaggtctcttagtcattctacctaactgcaaattcctaccctttgacctgcttctccccatttcctccctccccactcctggtaaccactcatctactgtttctatttttttaacttaacatattttttaggttctgtatataagtaaggttatacagtatttttctatgtctgtcctatttcacttagcataatgccctccgcatttatccatattgtcacaaatggcaataccttctttttaaagacagaataatactccattgtgcatgtgtgtgtgtgtgtgtctgtgcatatatatatccatatacatatatatatatatccatatacatatatacatatatatccatatacatatatacatatatatccattttaaaaatccattcatccatcaatgagcacttaagttgtttccatatcttggctcttgtgaattaatatgggagtgcagctatccctatgaggtgctgattgcctttcccttgtatagatactcaacagatagatcattttccatcctttattactcaaagacttaaatcagcaagagaaaggaattttgtaacacagaattgacaaaaccttaactaaagcaaacgtgaataagcctgccttttcaaaagcttttgtataattgctagtaaacgcacgatttccactagacttttttgaaatattgaaaatagcactggctctgccattggccctttagtgtaaacctgagcatctaaggtctctgggctggaagaatttcactagatgatttctcaagtcccttccactgcaaaaatgttctaaatctatgatctccttgtgtcaatagtgagttgatgcgagctggaggttggaggtccatacaaaaggggcatgttagggctggctgcagctctgtgtttagtacagtcttcctccattttgatgctatcattcaaaattggggttactttcaccggggttgggttgaagtctatctttactgagtttatgaaacaagtttaccacagtaaatatgtcaaaactcccagtaggctggatgtggtagctcatgcctgtaatcccagcactttgagaggccaaggtgaaaggatcgcttgagctcaggagttcaagaccagcctgggcaacatagtaagaccccatctctacaaaacaaacaacaacaacaaaaagcaaaactctcagtagcttgtgagggttgttggtaatgacatgggaagcacagcatttcctagcatttaacctctccagtcccatgtatgtacccatgaaaatgatatcccaataatgtatcatttttgccatctgaaatattttaacttccttggaaattttatagcactgacaaaaccacgtattaattgatccaatctattttgagccaggagctgtgctaggcattgctgggagggctactgaagtatataataaggtaagcttaactgaatttttacaaaaatgttttttagcagataagtctttgcaaatcatatgcattacagaggttttgttctcattctcactcctagggaaacacaaaaagagatggagcagtaaacagagaatcaaagggatctgggggaggtaaagtctgcttgctgttgccacggaagcagacctaacaaagaagttaggacaaacggcttctgttgtgtgaggtgggggtccacttcctctgtactggctgggcatcattagttagtagagatataaaaaaatatgctgaatgcagaccagaaatgattcaataagtccatgaaagaaatatttattacacacctaccatatgccaagcatgtgtaggaatacaatggcaaatatgtcatggtccttgtcttcaaggagttctgaaaccaaagaagtcacatagggaaatacgcacccctgggtgaaaagtgccacaggagtaccaggcaacacagggaagggaatggctaattccgttgtgggttactggggccacctcacagaggaagtgacattgaggctgggccttgaagtaagttttagcctaattacaaagggcttcgaaggcatagagagccatatgacaaacttgtgaacactcattatcagaggtggctggacttgagtgggggaaaggtgaaaacgaagagaaactagtattgggccagagtgagaaaaatctggcactgttacaagtcatcactttacttaaaataaaaatatttattttccccaggattcaggggtgtgtggttctcaggagactatttagccaatgattggacagacattcagtaatcatgaaaaacaagctgttattttagatattaatagttaacaggtaagaagttctatttacaagcatttttaatttgtcttaaaaaataattttagaatttctataaatcacccatttttagttatgtaaggcataaaagtattttttaaaattgaatatgcttccaatatgccacaggaataggtttgatttgacaaacagatttgtcaagtagacaaaggacaaatattttcattttatactaacaatttatgctgtaaatatatccattattgtgttcataactatgtgttgctctctcaaggcactggtcttgttaagcatagggaaaaaacaagattaattgtgtttacaataaaatacatgaataaataaataaaatatttgaaagttttatggataactattacattctgattaaaaggtatatgttgagctgtctataggaagttaaagtaaaaggagactacattgtggtatgtgggatgtgagagtgtgtgtgtatagaaaagggaggaagttggacagagatacattaagaagagaggctgggaatagtttctgggacattattttgtgcaagcaaatgacaattaaaaagttaaacaaagaaagatatcaaagagtgaagattttatgagttacataaatgaagaaaggaaagaaaattttagtactttaggaaagaatgcaattaaatatacatgaagcatgcataagtgtctatagtacatgcagtacacaaaatatacattactgaatgtgtgtgcctatgcaataattatttattaagcacttgctatgtgccaggaacacacaaggctatttcttcctttcttggcatttttactggatttctatgcatttgacaaagaaaagctgtagaattttctacaatgatttgaactttcttccactatataataattgcatgggggtatatttttaaatatatcaagtcagagccgaggtgtaactatgggtgagttttcccaaaataaccaatcgctgtcaattttgtgagtgcgtagtgcctttttcttttttttgtctcagtccagagcactctctcagaatttaattctgaataatgccgtgttatttatttattcatttttaagtttctactagacttcaggttttgtgaattgagttgagtacactcctcagttcatggctccctatgattgttgtcttattcggggaccttttaaatttttattcagtttttccctttatcccctctcgatccttctcccttgcctgtaggttcctactcctgtgtttttaatgtatgtccttttcattcactttccataaatttattacatagagggggtctaggttggaggagctgaactgtaacctcaaaggaggtcagaactgtggactcgctgccttttatcccttttgaggctggaggatcaaaggttagagataaaattgtttagaggagtatcaaatgttagagataaaggtgctttagacactctcagccctatctatatagattccaccatcacccaataagacagctggggtgggattggggtcaggccagtggaaagggggttgcagtttcactttgaagcaaaaggtttggtaattggcaatattcttatttctagatatcttcccagattgttatcataatggtccctgttggatgggatgaaataaacttttttttattaatacataatatttacacatatttatggggtacatgtgatatgttccagcatgcatacaatgtgtaatgatcaaatttgggtatctagaacatccattacctccaacatttgtcatttctttgtgttgggaacatttcaagtcttcttttctagctactatgaaatatacaatatactattttcacctattggcactccactgtgctatcaaacactagaactttccttctatctaactgtatgtttgtatctcttaaccaatctttcttaatctccctccacccccctactccccaacccccgccctcatccccccaacccctgctctgcttcctagcctctagtatctatcattttactctgtacctccatgagaccaaatcaactcttttagctctcatatatgagcaagaacatgcaatatttgtctttctgtgcctggtttattttgtttaacatactaacatccagctgtatccatgatgctgtaaatgacatgatttcattcttttttgtggctaaatagtattcaattgtgcatacataccactttttttatccattcattcactgatgaacatttaggctgatttcatattttggctactgggaatagtgctgcaataaacatcggggtgcagataattttttaatatactgatttcctttcctttggataaataaccagtaggagtattgctggattgtattgcagtagaggattgctctatttttaatatttgagaaatctccatactgttttccatagtggctgtactaatttacattcccatcaacagtgtataaggtttctcttttctccacatccttgccagcatcagctatttcttgtctttttaataatagctattctaactgaggtaagatgatatgtcattgtggtttgaatttgcatttccctgatgattattcatactgaaaatttttcatatatcggttgaccatttattttatttcttggagaaatatctattcatgtcctttactgtttagtggaactattttttttaaactgttgagttgtttcggttgccaaatgaatagtttgtgaatattttttcccaatcaacagattgtctcttcactctgctggttgtttcctttgctgtgcagatgctttttcagttaacatagtcccattgtctatttttggttttgttgcctatgcttttgaggtattagccataaaatctttgcctagaccaatgtcttgaagtatttcccctgtgtttcttcttgtagttttatagttttggatcttaagtgtaagtctttaattcacttaatgttgatttttttaatatggtgagatataggggtctagtttcattcttctgcatatagatatccaattttcccagcaccttattgaagagggtcacatttccccaatgtacattcttgttgcctttgtaaagaatcagttggctaaaaatatgtggacttacttctgggatctctattctgtttcactgatctatgtgtctgttttcgtactaataccatgctgttttggttgctgtgtctttgtaatacattttgaagtcaggtggtgtgatgccttcaactttgttctttatgttcagaattgctttggctattcaggctcttttttttggttccatacacattttaaaattattttttctatttctatgaaaaaatggcattggtattttgatagggattacattgaatctgtagattgctttgggtagtatggacattttaacaatattaattattctgacccatgagcataagatgttttttcatttgtttgtgtccccttcaatttatttcatcagtgttttgtaattttcctcttagaaatctttcatctctttggttaaatttattccttggtattttaaaaaagctattgtaaatgagattgccttttttatttctttctcagctagttcattattggtgtatagaaatgctactgatttttgtatgttgattttgtaccccgaaactttacagaatttatttatcagatctaaaagtctttaggtttttctgaatgtaagatcacattatctgcaaacagggacaatttgacttctctttttccaacctacatgtcttttgcttctttctcttgccttaactgctctggctaggactttcagtactatgttgcataggagtagtgaaagtaagcatccttgtcttgttccagttcttagaggaaaggttttcagcttttcctcatttagtatgatgttacctgtgggattgtcatatatggcctttattgtgttgaggtgtgcttattctatgcctagtttgttgagagtttttataatgcagggatcttggattttatcaaatgtttttcaacatctactgagatgatcatatggaggcttttgtccttcattctgtttatgtactgtatcacattaatcgatttgcatatgttgaaccatccttgcatccatagaataaaccccatttgatcatggtgtactatctttttcatatgctgttggatttggtttgctggggattttcacccgtatgtttatcagggatattggcctatagttttctttttgttgtgcccctggctggttttggtgtcaggataatgctggcctcatagaataagttagggaaaattccctccttttaaatttgttttgaataccttgaagagaattggtattagttcttcctttaaagtttggcagaattcagtggtgaaggcatccagtcctgggctttttctttttggggagactttttattactgatttcaatgcttgttattggtctatttagggtttctatttctttctgattcaatcttggcaggttgtatctgtctaggaatttacgaatttcctctaggttttccagttttttagtgtatagttgtttataacagtctctgatgatcttttgtagttctgtgatatcatcagttgtaatgtctcctttttcatttctgattttgtttgagtcttctgttttcttggttagtctaactagcagtttattgattttgtttatcttttcaaaaaacagctttttgtttcattaatttttgtatttttttttttttagtctctatttcatttagttctgctctttattctttctttccatctactgattttgggtttgatttgttcttgcttttctagtaccttgaagtgcatggttagattgtttatttgaactctttctacttttttgatgtaggcatttattactataaacttctctcttagcattgcttttgctgtgttccatacgttttggtatgttgtgcttaaattttcatatatttcaagaaattttgtgatttcctccccagtttcttccttgaaccaatggtcattcaggagcatgttgttttgtttccatttgtttgtacagtttccaaagttccttttgttattaatttatagttttactctactgtggtacaggctggtctcgaactcctgagctcatgtgatctgcccaccttggcctcccaaagtgctgggattataggcatgaaccaccacgcccagccagatttgcatttctctaatgatcaatgatgttgagctttctttcatatgctcgttggatgcatgtctgtcttcttttgaaaagtgtctgttcctgtcctttgcccacttttcaatggggttttttgtttttttcttgtaaatttgtttaagctccttatagattctggatattagacctttgtcagatgcatagtttgcaaaaattttctcccattctgtaggttgtctgtttattgatagtttcttttgctgtgcagaatctctttagtttaattaggccccatttgtcaattttttctgcagagtaaacattgctcttatcagcacatggagcattctccaggataaaccataagtcaggacacaaaatgagtttcaacaaattttaaaatattgaaatcacagccaggcgtggtggctcacgcctgtaatcacagcactttgggaggctgaggtgggcagattacctgaggtcagcagtttgagaacagcctggccaacatggtgaaaccccgtctctactaaaaatacaaaaattagccgggcatggtggtgggtgcctgtaatcccagctactcgagaggctgaggcaggagaatcacttgaacttggggcttcatacatcattggtgggagtgtaaattagttcaaccattgtggaaagcattgtggcaattcctcaaagagctaaaaacagaactactattaaatccagcaatctcattactgggtataaagccaaaggaatataaatcattctatcataaagacatatgcatgcataggttcactgcagcactattcacaatagcaaagacatggaatcaacctaatgcctatcaagaatacattagataaagaaaatgtggtacatatgcacctggaatactatgcagccataaaaaagaatgagattgtatcctttgcaggaacatggatggagctggaagctccaggaacttccagcaaactaacaggaacagaaaatcaaataccacatattctaacttataagtgggagctaaatgatgagaacacatggaaacatagaggggaacaacagacactgtgcctactggagggtggaggatgggagtagggaggggatcaggaaaaataactaatgggtactagccttaatacctgggtgacaaaataatctgtataacaaacccccatgacacagttttacctatgtaacaaacctgcatatgtacccctgcccttaaaagttaaaaaaatgtgtaattgtctgttaggtccatttggcttaaagtgcagtttaaatccagtgtttcttcactgattttctgtccagatgatctgtccaatactgagagtagaccgttgaaattgacaactattaccatattagagtctatctctccctttagatctaataatatttgctttatatatctgggtgctctggtgtcatatatatttagaatggtcttttttttttttttactgttctttttttaacatgttctgtggaatagtcaatctgtttactgttttgacttaaagtctgttttatctgatataagtataggtattcttgcttgcttttggtttctgaaggggtgggttgcccctccacacctgtgggtgtttctcgttaggtggaacgagagacttggaaaagaaaaagacacagagacaaagtatagagaaagaaataagggggcccaggggaccagcattcagcatacggaggatcccgccagcctctgagttcccttagtatttattgatcattcttgggtgtttctcggagagggggatgtggcagggtcataggataatagtggagagaaggtcagcagataaacacgtgaacaaaggtcgctgcatcatagacaaggtaaagaattaagggctgtgctttagatatgcatacacataaacatctcaatgccttacagagcagtattgttgcccacatgtcccacctctagccctaaggctgttttcccctatctcagtagatggaacatacaatcaggttttataccgagacattccattgcccagggacgggcaggagaagatgccttcctcttgtctcagctgcaaagaggccttccttcctcttatactaatcctcctcagcacagaccctttacgggtgtcaggctgggggacggtcaggtctttcccttcccacaaggccatatttcagactatcacatggggagaaaccttggacaatacctggctttccttggcagaggtccctgcggacttccacagtgtttgtgtccctgggtacttgagattagggagtggtgatgactcttaacaagcatgctgccttcaagcatttgtttaacaaagcacattttacacagcccttaatccatttaaccttgagtggacacagcacatgtttcagggaacacagggttgggggtaaggttatagattaacagcatctcaaggcagaagaatttttcttagtacagaacaaaatggagtctcctatgtctacttctttctacacacagtaacaatctgatctctcttttccccacaggtttccatttacttgggatatattttcctatccctttactttcagtcagtatatatctttacaggtgacatgagtttcttgtaggcaacatatgattgggtcatgaatttttactcattcatggcaagttttatctttcaatttgttaatttaatccatttacatttatggttattattggcagataatgactatctctgtcattttaatgattgttttcttactgatttgtatatcctttgtttctttttttctcttattgtttgtcactgtggcttggtggttttccggagtggtaacatttgagtcctttttctcatttatgtgtctgctttaccagtgaattttataattttgtgttttcatgatgatagatattgttctttcatttccagatgtagagctcccttaagcagaagatgaacttttatagattagtatttaataagactcaaagcttgactaaaggcatgtgatcaccccataatctgtgtaacatgagcctatgatctcctgggcttacttgtgtatctgcaacacatgtctactgagatcctttctagagaagttctaaaggactatcacattattacttcacatgtgtggtgtccttacactgcatataacagctagaacatgcactggatgagatggaaacagaagcagaatgggggtagggctgagcaaggcatagtctttaagttctgactcagtcaattttttatcgagtcattttttaatctgagttttcagctctatcaacattccagggggctttggggacagccactttgactcttggaaactaggctgagagtgtggttgctgtggcagctgctgttggagtgtgactggatggagcacagtctcagctgtacttgtggtgacagggagacaatcatggctcccacccacctccctatactgactgctccctactcactgagcatactaacaaaaaaccttacatcaaagcctcctggaataggtgagggagatggaagaagccacaggaggagagggtaaagaagggagtaaggtgggtttacatcttacctgcaaaatgttacatgtgctgcaatatccagtgctgtttctggcactgaacctacaagtagcccatgcctacagactaaataggcatctatgagaataaatacagaagtgacttgggcaggatggtgctctttggaacctttccatatatatatatgtatatatatatatatatatatatatttttttttttttttttttgagacagggtctccctgtggtgtccaggctggtctcgaacacctgggctcaaaggatcctcctgcctcagcctccaaaagtgctagaattacaggtgtgagccaccacacccatccttccataatttcttgttgttcagagtcatgtaatgctgggtaggggcccagctttgccctcttggggtacctccgactgtcctacagaacttagtaaccatctatggcctgctacatgcaaggtcctctctgtaccacaagactcatatcagatcacagtaaacgccttcctggcctgaaacaacagctcagaacatttttccattttattcactgaggagcactttttatcaactatgcaattaagtgcacctttgtttttatttttatttttttattatactttaaattctggggtacatgtgcagaacatgcagttttgttacataggtatacacatgccatggtggtttgctgcacctatcaacctgtcacctacattaggcatttctcctaatgctatccctcccctaggcccccaccccctgaaaggccccagagtgtgatgttcccctccctgtgtccatgtgttctcgttgttcatctctcacttatgagtgagaacatgctgaagtgcacctttatttttaaatcatttttagaatttcacatgcaaaatccactgacctagattaatgttaccaaatcccacctcttctgtttacaagctatgggactgtgagcaggtcacttaacttagctaagcctcagtttcctcatttgtaaaatgcaaatatttataatattagtcaacctaccttagaaggttgttgtgaggattaaatgaaattattcaagtgacatactcagtactgggcctgatacattcattgcttaataaatgttacctcccattatgattttcactcacagctgtttgatgctttaaaacagatgacacacttgacacatgatttttctgtcagagtggttgctattatgggcaatcttgtgaatgtcctgtgcagaaaggtgttgtaatcagctggaccacaaggaaaatcaaccaatcagaactcagtaagacctttcttataggaaagtgtgcccagatgtgtgggctcacaccagcaatagaatgccatagctgaatagtggtagttgataggacatttctaaaaatggcaccaagtaattgaaaaacaaatgacccatcaatggcaaacaattgcaaaatattttttaacttattgcagaaatatctgcaagtgggagtaggtggaacatgtacatacaacctaaaccagcgtatttgaaggcacaaaggtggcacccaggggaaagcttttgtttcaggagggatttctgctgagaacccctgctctctacagcctcatactgggtgagaccaaagggctgccagcattgctctgacacgcacctggggatgtttctcgtgctgtcccatgcaagcacgtcttctttgaagcttgtaaacattttctaggaggctggccctctcttgcttgagtaagaagagcaagcatgttttctgctgcctgtccaaagagaaatatcagcttcaggggtagaaaaaaaaaggaaaaatgggtcaagtgttaacaggccccacagcttcttaggctggaggggctagtaggatttgggctatctcgggatcctgctatcacacatcctggctcctgtattacttcattatactactaagtttgaagacgggagtaagaagcagttgggaacagaagaagcagaagtaacttccatttgcatggctttttgcaatttataaagattccataagcatgtcctcatttgaacctcccaacaaccctgggagctggggagacatgatcattcccactaaacaaatgaagaaactgaactcagatgaagtgaactgctccatggaagatctgggttcatagcctggtcttgccacaatttttgtatagccagaggcaagtctttagtgtctgtctcctcctctataaagtgtgcaccttcgattagttcaccttaaatgatcttttcagctcttatattctccaattcaacaaattaagtaaatagacccttcccagcatacaaatcatgctcagtgaatgcccattccacacaaatgaccattccagccaaggactcgcatccctgaagcaaggaagcattcaaactctcctctcctccttgctgctggggacacttaggcacccacttcaaacactagacacttcaggaactctccttccctgccatttatactggctgagggcacattctgccactacatgggccctgtgcaggggagaggaccttcaagcgtgtggccagggctgtacttggaggaaatggcattcatactggaatgcaaaatgactttttctgttggaatcagattttaaaagcttcttgagttctataatgttaagatactatagttagttacattatgaattaaattggctcctctggaatagactggaaacctcactttcctattcataggtttctccaaagtaaacattttaagtttcctgtggttcaggagcacaatctgtctgtctactgcacattatcctgacttctacttaaccatatttcttacctttcagggttgtatcacccagagtctctggtccagagcctggcacataagtatactcaataaattatctcagatggctgcttttccccctgtataaccacttgcctcccttgctaagttcctgcgttcctccattcctcacagactaaacagtcatgtgttcacctcagatgatagatccagagtcgagtaaagggactaaggcagtgtggtggatgatgtccaaatgttttgatatcaacaccatgctctgccccaaatcgccagcctggctccacggttagacacaacactgggctgagaggggcggggaggattcttggcctgtcagggtggcatttcttatctagtgataacctaccatagaacaaggagtagaaattgtgtgggtcttgaaagatcagcatgtcctaggctcaggatggttgctcttagtgtttagatatctatagaactattccaaaaaggtttttataaactcccatacgagaaactcatcaaatatttcttttgtcaattctatttttgctttctaagagcatacaacataataggagaaacagacatttataaataactctgatactgggcagacagataagtgctagtgtagatacatgatatacaaatacagtggcttgagagactatttcaaactagaagatcttaaaaggagttttgaaggacatgagattagaaccaggccttaaagaataacagatcttcaacagaagaccctgggagaaggcaagggaggttgcagagaggaaggagaatgggtagagggcccaacacgagtcagccagagaggtggggcctgtagaaggacaggtgcatgaaggatcatgctcaaaaggaggttgtggaggactttgaaaggcaggcttaggagtttggactttactccataaggatacattgaaggagctgaaggagggagtgctgggataggccaagttgtgtttcaggaagatcatgacagcatcagtgtggaggatggactcatattgggtggtggaaggtgggtgccaggaataaggctgagcgaaagcctaggtggaatgtttggggcatctaaacctagacagggtcagtgacgtccaagcttcccatactcaccttcaagggcccattaactggatccttcatggtttcctctccaatgtcatctgcaaacgctaatactgtaaccatttagttccattttggtcacatcaaactgctcatggtctctggcccttcctgggttcctaacacagagggcctctctcttctcagctgaggccaacttgaccccccatctccacctatactcatacctacagggcttgtatgctaagtttggcccagctcccttggtgcaatactgacatgagctaggaagacctgccccatgtagtttatttccaggtcctggccctcttcagtgtgtcccagcctgctgggtctcacactgctctgcccttagctatgacagaagggattttgatagctcatccaggcccacagaaaggagagacagagatgagacaaagtgggtaaggctcagctacccacctttccctgcctcacaattcaattaggactgttcaatcagcattggccagttctgtgcgtgagcttacaggagatcgtatttgaagagcttccctattacaaaaaggctttaaatgcactgacctagaccaacttcttttcgatgcaaaaatggaaaacagtgttggaaagatttgttctttctatttgcttcccggtcaggcgcctacaggggcccaggggcaggagcttaagtgtgagggaataggaaccttgtcccaaggctttggaatttccattcagtctgtttctgggtacagcagttgttcagtgcaacttattttgagaaactctataatccttgactcagaaggtggtggctttgtgaatctatattgagcaggaggtggtaaagcaacccggtagagccaagacagggctgtggtatgtggtggtattagggatgggggtgggatggaaggcttggccagccttccttcaggagacctgggacaggaaaacaaccttcattgctgccaccaggtgcccagtctccccttacaaaagtcctgtgaggtactctttattttcagaagtcaaactatactttcctaaaacacctgctcctgacaaacaatgtctgtttcagcatttatttttagccaattttagctgccacccaaccctgctccatgcttggcaaagatgtttaaaagctacggattaaagagggatcaggcatcaggctccagggtttaccttatcagagggaaacacctagaactgccatattcccttctctcccacatctctatagggatagccagcctttcccttgcttggccaaaagaaagtgtggctacttacacagaagagtcgtagctgcttacagagttccctctccctattgattatcagtggtggcactgcctcaatctgattgcactcagtaagcaagccctcctttacctcatttcccccattgtgtgtcttctgcttctcctagtcctaggcatgcaccacatttattcactcagtgagagttgggcatgagccaaccaggcagttttccaaagtgtcaacctatgatagttgctaaagcattactgtgctctaaaacatcactggatgtagtgaaatgaagaatagctttaccagaacatctgtcaaggagaacactaaattcttttcatctattcattaaataaatgtctatttgtgcctattccattcattcattcattcattcattcaatagatacttgtttagcaccttaaatgattatgtgctagacactggtctggtctaggcattgggatatagtaataagcaagatagacaaagtctttgccatgttagaacttacatcctaatagggagatggtcaatatacaaggatcttgggtcaagttcttcacaaatagacactgagatgatttgggtttagtaatctgtcatgaaatccaaattaaaggttataaaggcagtatgggaccttgtgggactggaaaaattgaactttctgggcctcaaacaatgggagttaaggtgcaaagtatatttgggcaacaaaggttcattaagatttcacagttatacaggaggactcaggctatgaaaaagatcagcttcaagttattacctccatactgaaccctgtggccagatggttatagggtagcctcagatgagttgagagaggcatgagggtgaggaaacaaagaaataggacagtactaagacttgtgtctaggaaagacttttgggctactggcacatgcaattgactggaagcaaatagattagaagcctactgtctttgagagaattgtgttggcagataaatcataatcctggctaaaataaataaaaaataccctgaaatataaaacagctctcagggctccaaatctgcactagcaggaagcaggctgtgaatgttgtgtagttccaaggaaggccaactcaacgatgttcatttcagatgagaccatggaggaaagtgtacacggaagaatctgccaaaggtggagccaggtaccagggagaacaatggacaaggaaattccaccagagatcagaattaagatctaatccagaaatttcccctcatattggagcaggcagtttttatcgtgcctattcaagcaagatttcatcattgtgatggacaagagactgctctgtagctcccattcttcccttcccgaaagaggactttagaatgtcctgtactattcctgtgtttctacctccatgttgtattttgggtggtgattagtggaacacagatagttgttttgagtttctaagtctccagaccataaggaggtagatccagacttgccaaaaagaactgcacacctctcagagatcctagactttgagctggatgtggtggctgaatgggattttttatttcgtggtgtgtgtttatgttctaagtgtttaagtatgggaagaaaggtatccactgatatttggtgatcaattttgtattttttttgtatagatggggttttgccatcttggccaggctgatctctaactcctaggctcaagccatccacctgccttggcctctcaaagtgctgggattacaggtgtgagccaccattgccagcttgtcatggagtctaacatgtaattgtttcaagcatcaccataatgctaaaccaaatgcataattaccataatgcatttgcctggcacacagataacattagacctagatgactagctgttcaccaaatattcatatagaattgacattgggattgactatttctgagcatcccttccatttgtgtaactagctatccccaatggaatatgagtagaagtgatgtgtatcacttccaggctttgatttttaagaagttgatggggatgatccacattctcttctcctgtctgtcatctgaatgctgggaatgttcagcttctaaggaatactagagccaaaagatggcccctaaacaccacatgaagggatactgcaaatcagaaatatatactttggacaattacatgaacaagaaataaattttcattttgttaaaccactgaattttgttgttgtcattgctgttgttacagcattatggtaattatgcagttggtttagcattatggtgatgctagaaacaattacatgtaagactccatgacaggctgggcatggtggctcacgcctgtaatcccagcactttgagaggccaaggcggactaatggcttgagcctagaattagaaaaaaaaaaaaaaaaattagctgggtatggtggtgctcacctatagtcccagctactagggaggctgaggtgggaagactgagcccaggaggtcaaggctgcagtgagctgtggtggtgccactgtactctggcctgggtgacagagtgaaactctgtctcaaaaacaaaacaaaacaaaagattccatgacggtgaatcaagcatctgttaaacccgtaagtgatgttcctgacagaagcatggcggacagagaaggcaaatccatatccagataaatatctgctccaatgagaaccaaattgttgccccctccatgaaaaggaatccaatgtaatcagccttccaggcaagtgctagactgagacctctaggccatggtactagattaaaggtttcaaggttagtcactgcctctaagaaattgaatactcagcagtggtgtggtcagatcagcctcagtaaaggaaagtacttgttgagcttatctatgatcttaatcctaccaccatggtgatgttcataaactcactgagaaaaatactgcggtgagtgggaaagaggttgactgacattcatatggcatgaaatcttgtacactatttgagagtctcctacactgtggacacctttgggagaacattctcatggaataaatatattttcacccattatgattagtttgtttatatgtattttccccaaaactccttgtcacaaatccatgaagtttattccttccaagttcctgactgcttaaccaaaccattagcccttgtccatgaattggcttagatccagatctcaggtcatttgtccttccacacaaagtgcaccatgacaaataccactcaaagctctgcatagtggaaggatttcccttctctaccgtcctgcagggtcacccctgaagtagagctgtaagagcagtccgcttactgctggtgccagaatattatacaaatccatctgtaaactagattattttaggctggcattgcaggtaggagatgatgcaattgaaatgagctccctgatttcacaggagatgtttggatcctggagtggaagaggcaacacttagccatcagaggtagggcagccatggttactacaaagaacatcagggccagagtggaatcagcaggtttgacccacgggaatcactggaagtattaacctgattatgggtccctaagagcaacatagaggggcagctcagtaaattacttctttgactggataatcaaataaactggaggtctgacaaacataagcctgacacaaatcaccacggtagagaatctagaccagaatcagttcaaagacccagagctccttgaataaaagaaagtctgcgccgagattggtggctcatgcctgtaatctcagcactttgggaggccgaggcaggtggatcacgaggctggttcaagaccagcctggccaacatggcaaaaccccatctctaatcaaaatacaaaaattagccgggtgtgggggtgggcacctgtaattccagctacttgggaggctgaggcaggagaattgctagaacccaggaggcggaggttgcagtgagccgagatcatgccattgcactccagcctgggtgacaaaagcaagactccatctcaaaaaaaaaaaaaaaaaaaaggctgaaaacactacagaaagaactctgagatagtgtcacaagcatgtactacaaatctttgtatccttccccatggaggccctcctacagccatttcccaaataactgtgcactgggggagaggaaattctcagaccttttcagagtttattgaacactagctctaagctaaaccctgacgacccagaacatcactgtaacacaccagtcagggtggggggctttggggaatgggtgttgtgacttagagacttttattttttcactctctcaaaggtatcagggtaggtggctttagctcaggcttcctgcctgaccaagatagtgaggaggaaatacatggaatttactctaagtccttatcacagtagtcccagtaggtccacaaacacatcctgtagtttcaccccaagttcctgagtgtatattggtaataaagataccaaaacactaatagaatcttcatgtttctccctgacctgtagaatgcgggctatcacagtagaaagaaagcggaatccttggaactacccaaccgaaataggggaccaaagcaatgccccatttatggtagaatcacagtagaaccaccgtcaaagccttgaaagaggcaagaagggtgacccccactatattcccatttactaggacaaagttaaggggtaaataagtggggttccacatgatcaatacattccaacattcctgtctccctaaatcattggattccttcctctacattataccaaagaattaccattgttgctgatgagaaatctgctgtacttttttgtctattccataacttttagaaatttttattatttttaatgttttatagtttatctataatgtggagtttacaaatctatcatttaacacttgatgagctttatgaaactagatactaatttttttcttcagttctagaaacatttccaacattctatcttcaattattgactctttcccattcccttctctcttgaaactcttattagactatattagagtgtctctctgtctttcaatttttctttcaggttttctatcttttaattcattgtgctgaaactctaagaaaatttcatcagttctatttctcaggtcactcattttctcttcagttctgtcaaatcttaattttaaccatttcttatttaaatgctgtatttttcattttaaagatatacttctgtttttatctccgtgttcttgcttcataaaccctgtttttcttctgtgggtgctactccatcctttatttctgtaagaattttcaacgtattttaaagtcttttttcagattattctgttatttgtattttctcaggtgtgattttccagttggttgtgtatggtgactcatggtgctgactttcctcaaatgctttatcaagctcaaattctgagcttgtcttccgtggcactttttaacagttttattaagatatacttcacataccacacaaatcacccatttaaagtataactcaatggctctcagaatatgtaaatatctgtgaatctaccaccacaatcaatttttcatgaccccttccatgacattttattccatatgtacccctggactatgatggcctcactgcacagcacatttgcagtttcaatgcacagcaccaaagtagggcttatgtttgaagcttggctcaagactcagccgctgagaaaatagaatactgagctctgaactcaccacaaaggtctatgcctgagtattatgcaggtgacttttctttcttagcctctggtaggcaccttgtttttgtgtgcaattccagaaaataggacagagctattccaacttccttctttaggtatccacttattcagggattctggttcaggccctttgccaataataggactcccaactagaacagtggcctctatccttgcttgggtgttgaaaccatggccttgatgatgcttatgtgtttcttcttcccatggatcatgaggctccaatctttgcctgtggctgtaagttccttccatatatttttttttctccttttcttaagggtagaaactttatttttggtccatgaagacatctcttcctagcgttttatgtatggatggagttttaaatactcaatttatcatattgtattagtccattttcacactgctataaagaagtgcctgagactgggtaatttataaaggaaaggtttaattgactcacagtttagcatagctggggaggcctcgggaaacttacaatcatggtggaaggggaagcaaggcaccttcttcacaaggtgacaggaaggagaagtgccgagcaaagggggaagagcgccttataaaactctcagatcttgtgagaactcactcactgtcacaagaacagcatgagggaactgcccccatgattcaattacctccacctggtctctcctttgacacatggggatttatggggattattggaattacaattcaagataagatttgagtggggacacaaagcctaaccatatcatatatataatgtggaatgaaagtgtgaggttcagcctgtgctcaatccacccttgtgccatggaattggtaaatgcccttttaaacaatcttccagctgtcccctcaggtgctcagggtacttatcttgtccttgactccccaggatgcttccactggagtaccccatactttgagccatcatccctacaagataggctctctgggagcaaaatgtgtttgcagttttgatgcaagtacacttacaggtcagaactattcctgtcctttaaccctggtcctgtagcatgggaaagtatgtgcaggggacctcgtagcaggctgctgtctatcttcatctacacatccttctctctggcctgctaagatagaaggagcacagagaatctcattaaagctgcacctgtgatgggacagaacatcaaactagaaggaaacatgggattgtaactgattctatcactaactagctctgaggccttgggaaaaccactttgttgtctcagcttctaaaatgggaataatgataacagctgtttattatggcaaattgctgtccatttcattcatgcagcaagtatttcagagacagcctgccttgtggaatgaactgggttctggtctcacctctgtcaccaactctaactcactgggtgactttgggcaactcaaacaagatggaaattctaggagcaaagatttcagctaaaagaaaactaaaacatttctaacagagctacctaatgataggctgggctgtattgggaaatggcataagcatatctaatatttattcagcaatcactttattaagctattatactaagtgctttacatgccttgcttcatttaatcttcacagtaatcctatgtgttagatgcttttacagatgaggaaacaagctcaaagaggttaagtagcaaggctaagatctgacccaaagatccatgaaaccaggccgagtccacttaaccactctgctgctttgccagtggaaatgctcagaagaaggtggaagaccattggcaggcagtggagagatcatagcagcaattaggttaggctagatgactgctcagccctgaggttctaggactcttgctccttccaggctcagtttcctggaaaataagagttaaatgtgattgctaggggctcctcaccattataaaatcctgtgactcatgtgctagggacagagggcaacagaaaagtaacgtcagatgtactctctgatgtcccagagtatagttgggagggcgagtcatatctcacaacctccatgacccagtgctctgttgtatgggaagggaaagtcagtggggtggatggaaagtgttggaaggaatgagcatgggggcttagaatggcagggtctaagtaggtgccagggaaaggaagcagaaagtgcatgtttgaaaagccagaggtgtttccctttgaaagcttagctgctacacagagcagctctatccatgccttgacagctcccagacccagctgtcagagggcacctttcactctctttaaccagctgaagtgccctggctgtcctgaactcaacacctccacactctcagctctcctgcctgagcccgacatgggaggcagagcaaaaggccaccatcattttagctgccccctcccactcccacagaacccactgggttaaaggctgctatacatattaaaatagggaccccaacatgtgtgagtatgtgtgtagtaattttttattttcctaaaatcttgagactattttagggggtagggaagaagacagacaagttagtgacagggaagtccttgattaactgtttctttccacattttaatttcctttctgatagaaaattcaaataaaactggggggctgtcacagtttgtcagtggtggtgggggatgggaggcaggatgtcttggaaacataggaggacatagggacatgatagtagcaacaagcttggatatttcccaagcagggccttcagagccactgtctggagaggagagctctttggataaaccgttgtgtctgttggaaagtggtcatgctttcatgctcagtgtaagtttccattggtgctgtatttcaccatgcacaggcagcacaaggagaggaagaaaatgcccttttggaaactagtttgtagataaagtgaatcagcaaaagacaaggtagaatccagaaaaataagaaagaacaacttcagttcaacatggcagatgttttccagcatctcttgcctgcctaacgttgtcctaaatgttgcaaggcacaaggtctggagggaaaggtctatccaggtagacaagactcacacacagcaaaccacaggaatttttaaaaatccctataaatgctggcaagaatactatcaaatgtcagaatgtttttccctacacacatatacttgttctagcagtgaaggatacctactaactttgatgctccaggcttggtctgaatgtcatactattgtagaatgaggaaagctacatttcaaaccggaatcattggctcagtctggattctccaggaagcaggcctgaggcaaaggctgatgtgctaacacatcaatagagtgtatagccttaagggcaacaatagggaatgaggtgagaaagacaggtaaggagacagactcaataggaagatgtgtcatcaagcaggacactgctaagtgtcactggctgctcaatccacaggaccacacccttgagtagccctatcatccagatctcagaaccaccaggggagtgggacaggggtggagacaaacccactgaacagaggtttgccatgtgttgcattaggcccacactttaaggttgcccatgtgttggggaaagtactgagcagggttctaccactgcttccttagggaaatcctaggggaagtcagatgcagtcagctgcacccatgtgaaattgatccatatggtttccagacagctggaagaagaggcaggtgaggcggagaggatctgtagtaaagcagagaagggtctaacacacccatgatccctctactgcataataattgtctgaccgcagctttcctctctgaatccccaggtcctggtgctgcatgaggcatacagcaggcctgaatcttacgtttgttaaataagtgaatggaataaattttgttgaatgactaagacctaaagcctcttagtcattcctgacttcttcctaccaccatcccccaccccatacctgaccagtcaccaagtcctactgcctgtgttcctagctcatgctgacccctctcccagccccaccagtcttccctgtctcacctgctgcaactctgaagtgtaactctgaagtgtagccctgatcatcccactcccaacacacaaagaaactcaacaggtcgttaccacttacagagtgaaagtgtccagcatcccccactgcgcatcccacctcttggcctcactccctcagggctcctcccagctcctggaacacatcagttccttatcggttctgttgctggtgtttgtttgtttgttttaatttgtgtcattttctcccaccgggaagtcttctcctctgacatagaaaatcttattcctctttcaaaggcaatttcaagtgccaccaactctatgaagcccttcctgagctcttcctcctccccaggttctcccgttcctctgaagaccttcagtgacattttttcctcttaccacactgagcactgctccctggtaatatggcattgttcccctcctctacaaggtcccgagtggttgagggcaggattctctcttacagatatcctcccaaacggtgcctgcccgtggccctgacatggtgtgcagtgggcggtcaccacactgggatgtgtaagaagggttcatgggggaagccttgcctcccaattcactctagtgctctgccattcccagaggccacagctggtgggccatccgctgtcacacagttgactgccagaaccctggggtgggcacctcctgctaaccatatcccatttaagggtgacagtctgagcccaaacaaaaaaattttcccaggcatgaggattgcagaaactgaaaggcagctcctggcagccaccccaggggaacaccaaatttagcccaaaagttgaatataaatatattttaagtgtgttaatttcaaaaatagcatcattacattaaaatagtttacaaaattaagagaattaaagcacccccaccaatccaccaaattgctttcatttttgtttgttgccctcaagtctttgctcttataaatgccttttttttgagataggggtcttgctatgttgtccaggctgccctgggactcctgggctcaagtgatcctcccacctcagcttcccaaataactgggactatagatgcgcagtaccacgccaagcataaatgcctatttttgcacatcgtaatcatgctacacatacaattttgtgtcttgcctttttacttaagaatatgtgatgagcacttaagagaagtataaggcaggtttaaatcccaatcctactgcctagtagctgtgcaagttactgaatctaagtctgtttccttatctgtaaaatggggtcaaataaccttgaaggattactgtaaggatgaaatagcaattcataaaatctcttagcacaatgcctagaaaacagcaagcacttaataattgaaggtgtatttcattattactattaaaatatgtgagggtttttaaattgacttttccccagccaactacaccctgcacaagcttttacaatggtttcaaatgtggaattttacctcaaacctttgtaaatgtaatcccctccaggttatattttatcacatttaaagacaagtcccaagaaggtataaaataactttctatcctgcccggttagctgaacagcagctgctgctggaggggatttagccttggccaggctgcagagcccagggcgatgaacactcctgaaaggttcctgcttagttctcactttctctgagaaaccctttgttagcaagtacatgcacgcagtcccataagggccttgaatcagggtaatggaaaattctgtcaggttgaagggactgagggggcttgagtcttgttgccaagcgatggcctcccccggggctgtgctgcccttagctgaaggtggagatagataaagaaaagcattagcctccaacccccaaatcatctccccacccgccggcttgatgaggtgcttagaagtctcatggttgtcattcctttggtttaaggctttgaaggtactgtatctataaacatcatatatattgccatgaagagcttgactcagtttattcatctgcagctctgtaattctgataatgggccccacaagagtacaagagcctgcttgtactctatccaagactctgtcctagtgccttgcttagtaacccagctactagggtgaagttccgctctgcccatgtcagactcccttccctgagtctggaagtccagctccaaatccagatcagggtctggggccctactgccagctgagacatgtccccagcagtgcctgcctgcctgtctggtgtcttacacaacttccacggcttggcttccctgctatgtgctcctccaccctccccattccccacctctctgtgtacttgatgttttgctgctttgacttccctgatgctaaggctactctgggccatgccctgctggctctttcccagcccctttggatatagtcttcttccaacaagcctggactgtactcctttctgtccccgagcacccctgcctcccctctccagccctaccccacggaataggcctagtttagaaggcccaaagtgtgttatcagaattgatactggtggattctgacagtcttcctgatcatgaaaaaaaaatagggcttttagaacttaacatatattttcttgttttaattcagatcttttacatatgccccttctgcttccttgagtaaaaagattactgtcctttgaattttttgcagaaagaggtatgtgtgttttgctacagttggcgccaaaccatgctgttttagttactgcttgaattctgtctttcaaaaatgttggactaaactgagataagggacagctgtattctggaattttctggaaggaatttagattcacccacctgggttcctcccctgcgcatcagtgcctggcttctaaactgtcacatctcagcttcaatgttacctcctcagaaaagactttccgctaccctatctgaatactagaatctctcagcccacctttgctaaccccttgttcccttcatgacacttgtcacaatttattttctttagccctgggtgtggtgaatcacacctgtaatcctagcactttgggaggctgaggcaagtgtatcacctgaggccaggagttcgagaccggccttgccaacatggcaaaactccatctctactaaaaatggtgttgcatgcctgtaatcccagctactcgggaggctaaggcacaagaatcactcgaaccaaggaggcggcgtttgcagtgagccaagatcgcgccgctgcactccagcctgggcaacacagtgaggccctgtcacacatacacacaaaaaaattattttatttgtttatttgtgttagagtgccttccccaccaaactctaagatccaaaaggcagaaatcatgtctggtctctaaaattatactcctaaagcctaacataatgcctacctgaaaatagctggtcaataattctttgttgagtgacaatattttccacttgaaacagtaaaaaactatagactctacctatctctgatgatcatcaagtgaccagtgaaagggaaaatccttaatcatattctacttaaaaatctaggattttaaaaaatctgtttattatcaaggaccaactgcaggggcttccagaacttcctgaggattgggacgtgggcagctccctccagcctcgctgttttcctgatttccacatcatgacagcaatccttcaagatgcctacaaggtgcctaccgtccttgttcttttgtttttctctctggtatcgcaatttgctattaggaaaaaatctgaaacccattcatactatgattttacataggagtattattagcatttaaccacttaaacacttgagccattggaatgaaacattctggtcttatctggcactggaggaagcaatttaaggaaatgggcctaaagaggcctgcaacttgagtgtgttcactctattaccaaccagcttatgctctttagtgatgaagctttagaaaggagggagaaagaaagaaaatgagagtagacatacatgaggttgaaatcttactataagttactttttgtagtccagcatataatgaactgttaaatgttaatgactatgtttataaacatgtgagatggactgtttttttttttttttctaggagaaaaaaatgggttccaagtgctttctctggttagactactgcggtatctctgggtggagcaccttatcctcagacagaggccaggtgtactcctaagtctccatattggtgtcataatatgcgttctatgatctctttgcaagaccttttttaaaaagctttcctgccctgataaacaagactgattggtagttaagattacacttctgtttgtctttcctaatcttctctcagaaatgacacccatttgttggtgaaaggctaagtggccggtcccttgaccctttgtttggagcaacagttatttctcttcttccaaatagatgaaatatcaatagcgagccagtgagaagcagccccactctcagggagctctcctgggcgtcagtttacgtatctgtaaaatggtgatacaaacacctatttcacagactcatccttggggtctatacttctttaaagccttctcatttttaggtccaggtcaggtctcccctcttctctgtgtagtttgttagttttttgttttgttctgttttgttttattttttatgtatcacctcctggagcctatggttcctagaattgatgataaatgaattcgtgtttaattctgttctaattgttagaatagaataatgtgagttactctgatcacattaggcagattgtgggcttgataaagggaagttctggaatcatccctcaacatcccattttcaaatactgtgtattcaaaacaataacaaaaataatcagataataacaacaattaccatgtaatgactgttatttcccaagcactctgctaaactctttacagtcaactcagttaacagccctatgaggtacttaacagctcagttaacagccccatgaggtagatattaatggggcccagtttacagatgaagaaaccaaggctcagagattgtcttgctggagtccagatgtaagttaacaactggaattttaaccattgcatgcctgacttcaaagctctttgcattactggcttactgatgggtatagtccaagcgctcccctccccaccaagtctgccatccttctcttgtagtcacagtatgaagtggacaacaaaagagagatagatgtagagatagattttattaagacaaattacacattttactatatttttcctttctaaaaccctcaccatcaaagattgatcccacagaatttctaattcaagaacactcatttcataaaacatttcagagatagaaggagagaaaatattaatgctaggcaatagattaaaaggtgtcccctccagggacccgggatgatcagacattccttcctaaatggcatcctagtcactttcctccacctctccactctcatttatctttccacccaacaatagcatccaagtgtcagcagagggcccagagatgggcaggtgagtcagaggttgaacctccttctgagcctttaccctcctctgtcccaacctcttgtggctatctgtttaggttaataactgccaggcagccggagaggagagcaggaagacacaagtttctctgtggtttcctttccttatttcaggactccccaagcctttacccatcccatcagcacccacacacacacacacgtgcattttaataatgtaataatccctctataagtctcagtttccaattccaagcatcgtttaccttcatccaaaacaacagcaacccattatggatccagtgaatacagagaccaggccaatccctggggaaggcaaggcttttctacagcccccacttggcagtctcattaggggcactagggagacataggaatctctgcgctctttaaataaaggccctgccaagagagctggagattcccctactatttccttgcccctgctaaagcctccaggagagagagatctgggggcctccatagctgtcatcacacctcctcttggcactaagttggcagtcagcaaaggaagtaaataggaggggaaaatagttttccagtgttttctctccatttttattttcatcttcacagcagaatttttttttccacaaggggaatctgagaggtacaatgctttctttgttttaacaaggcctggggaaattccactggcctcagtggctgatgatctggtcagggttcgagaggggacaacagcttcttggatattcctgttggtaaggccttcagggaatggctgggtgaacagccaagggagaaagggaagggatggtttctatcattggattgaactgtaaaggagctgcagggtgacagatgttggcaggaattccagtagagtttgtgtgtacagtgactccctagcagggctgacacctgcacaggctaggtgtacaccctagcagaaggaaaggttgcaacatcaccaaggtggggcatttgccagaggtacataccaaggcatttgtaaagctgaggctgctggtaaagttccaagaagccctttttaaggctgagtagagggaggagaagccaagggcaacccaaggccatctcaccactactccgaggaatggtccatggagacaacagattcaagagcacatataatgcaagttccttgattcatgctgtctattggctgggaactttgagctcttccttggaggagggagggtgatcaggtcaaggaggtaggaacttagagaacgcatttggtatgctgctggtatgtagagagagagtcattctatccctctggctatcccttccaggccagcttttgccatgcttcccttctttccctctaccctgtttcatgagtaatctgaaaggcttcgtatactgggtagagggtggggagggaactgcagtctgggtgggttgtcacctctcttactatcccagagccctggttatagtttctagaattaatgagcaacgtcattgagacccggggctcaaaggagccaagcagtgatgacagtgagaaagcatcagttcagaagggacacgtctttcttctctgagcctcctttgttcccacctggtcctgatcctcccataaaggagggtcacactgataggtcatctgaccttgccttgctgctggccttactaagacgtcgcttgtcactatgatagccatggggaaggcggtgacctggtgagactccattgggcacctcaggcttctggccataacgaacctggatgaaaccttccccaggagtctgctcctgacctcgtacttgctcggtgaccaggttgtctgtgttttgttgggaggccatattattgctgaagggattgaagaattttcccccagggccattctccaggcactgattaaagtcggggggtggtgtgcagctctggactatgcccacagaggggccagaaagctggcacttagccatgtgctgccgcggtttgacaaatcgctgtctgatcttcttccagcccaggtggtagagttcagccaggctaaggaggagggacagtgcagccacagccagcataaagacaatgaagacattcttctctgtgggccgggatacgtaacagttgaccgggtggggacagggactcctgcggcagacatgcagggtggtcaggaagattccgtagatgaagtactggcccacaatgaagcccacctccatggtggtgcggatcaggatgctgcacacataggtgttgagcagagtgccctggagggcaatccttccattcccttcctcccagcaggacagttctgccttctctgccaccgggtactcgtaagagccagagccccggacctctttggccctctcggcctcccgtagcttgcgcttctcctgcatgcgcacagtgtgcatggcgtggcccatgtacaccagagagggcgtggagacgaagatgatctgcagcacccagtagcgaatgtgggagatggggaaagcctggtcgtagcagacattctggcagccaggctgaatcgtatcacaccggaaatcagcctgctcatccccccaggaagactcagcagctgtgcccagcacgagcatacggaatatgaagaggacagtgagccagaccttgcctaccacggtcgagtgcttgtgtacttcctccaggaaatttcccaggaagctccaatcgcccatcttggcacagccagggaacagatgccaaaacttctgcaaatgggagagagagaaagagagaaaagaagaaggatgttctgtgaaggtctggaatgtctatcatgttctgggattccactgatccatccatccaatgggttctttaagaaaatgcaacttagaagtcaaagcaaccaacgaaaagttcgctctcctttcccagcaaaaataaaaagaaagagaagattcaaagtagccatattagcaaaattagagcatggctcccacactttaacggatctagaaatcgtggtgtgtgttacaatatggattctgctcttgccccagtaattctacttcaggaggtctgggatggcccccaggaatctggatttacaacaagcagcccaagtaattctgatgcaggcggtgaaggaccgcacctggagaaacacgagtattaaaaagaacacaagactggggtctgcaaatgtgactctgggcatttacctcactgagtctgtttcttcatttatcgaatggggatgggaatagctacaccagagaattctgaggattaaatgatatgaggtgtgtgatattctgaaaatcattccacaactgttccaaatgtttaaatggctgttggatggaaaaggaatttttttatggctccagagggcagaactaggtggaggaggaaagagtgaggatgggattggcaaatttggcccctcaggaagcactctgcaaaaatcagaaccatccagcatggaccagctgtgttgggaggtggcaaacaaaaagtgtgctttggtcacaccagctaacagtatcacagatgagtgctcacttcccctggctggtaaggcaatgttgatctcccatgcctcggtgcaacacagccattccagccacacagctcagctcgccctgctgctaagtttctgtgtctcatttaaataaggttcccacacacagatctgcccacccttatgtccagaataaatgtcccaaaactttatgtcccttacaaaatcctccctcatctggcctttgtctgcttttccagcctgttcctgcctgtccacatgagttccttttgtccagccatgccaagtcttcccaaatgccctccttctgtacccctacatgtcccctcacccctagctgaatcccatttacctttcaaaacttaacccagtcattgcctcctccagccctccctcttccctcaagctgagcctcttcagctcctgtgatggcccccgggacacttactcgtctcccagtgcttgctgccttgtgttgtaatcctctgcctgtctgtgttctcccaggagggactgtttgaaaatggagactgtcttttcttctgtatcaccagagcctggcccagagtaggtgtttaatacatcttagttgagtgaatgaaggaggggctgacaggcactgttgtttcctacccaatagaaaaccaattccctgtttcttgcctgcctcccattggcagggtgaaaaagccaggtatcactttcttaatctcctctgcagttagttctggtaggtgaggtatggggagaatctaaagtagagggaatgctccagaaaaggtttttctaccccccagtaaatggagagagcctcactcacagtgctcccatccccctgtgaacaagagggaacctcactcacagtgctcccatcccctggtgaacaggagggagactactcacagtgctcccatcccccggtgaataggagtgagcctcacttagccccaccgcttcctgcctgtggacagagttgtatgaaccaagatgtctaaagctgtccagagaatctcagaaatgtcaaccagtgccctgaggcctctgaagcaactcttgaggctccctacctccagaattcttacttagtgaataacgaatgttcttacagtttaagcctctaaccattcctaaccaacaggatgacaaacgtctcggagggaatggagcataaatattcctttcttagaatcataaacctcagatttgggtgggtccttagaggtttgtcaaattcaaactttgaccgtcatatctttgctgccaacgtgctcctggtttctgtctgaacattcttcttgcttatggggaaagatggggtcagggtggtgcatttcatagtccaggcttcctcagctcttgagttgattgttgccttgacagggaccaacctcctggccctgtattctctcagaccccaggtccccaaacttgagagtatacagtgtccctgggaatgagggagttcctgagtgagcggaaagcatcttatctctgctcctctctatatcaaagacccatccaggtcttgaggcctttcctgtcatttgtgatcagacatctgccccatttccttaggtggcgaagcgccccctctttcagcctccaaatgtggaaaattgtggagcatgtgctcaaaaggaaaatggctgattagataagagtttgaattgtctgtcctctcttctgggcacatgtacagtgttcagcaccttcagggtcagccacacacgtgcagtgactgaactatggtaaatgtctgagaaaaagagggagggagagaaggggaggaataaaaagaagagaagaaaagggaaggacaagggagagttggaaatggagaaaaagaccatgtagggttaagaaaagacagatgcaggagttagcttactgaggtttgacaaatttctattaccatctgctgggcttagataaatgactcaatctgtgttccactttcctcacctgcaaaatggacatactattaactcatagagtgctatgagatgatgcgtgcaaagcacttaacacagtgttcagcaaataagaactgaataaaaggtagccattactagcaacaagagcagtggggaaggatgagagtagaagaaggagggaaaaagagaaagcagaaagtagagaaaggtgcattacaaaggagaaaagaaatgggagcaagagtagaaggggaggaaatgagaggaaaatggaaatagaaaaaaaaagaaacaaatgtcatattcttccaggatttggggcaagttttccacactcagtccctgaagacttctcccttgatcttctcactctgtcactcattccttgcaagtccccaaggaagtataaaaatagttccaggcaaagaatgtgaccctttggtctagtctgccaagaggcttgactgctgactccttcactgctgtccaaggaattccacctggaagaggtaaagcacagatacaagaaaggaacaccttggaaaaccagaaaggcagtattaggaaggatatcttattgggagggaaaaagagaaactatctgaggaggtataggggtgaggcagacctcctgggcccaggcagaggaaatagggtgaagggtttttcatgtatgacttcctgctgacgctcaggcaaggtcagagaaacttaaaatagctaccatgtaccagatgctcagtttataatgtgaaaggtctctggctgtagttacttttccagctacgttggctccctttggataccccatctcagccaaagaaatttgtagattagatactcagtgagtttactgggcgtatagcatataaaatactttgtagattattatctgcttcttggcaggaagtgtattaggaggggcaaaggaagctgcccatgccatgaataaatgctatcaaacacaatggcaatttacctcactgctttagcagttatcctcactggcttcctaccacttagaaagtccaaactgcttaacttgccatgtgaaaccctgtacagtcttatgctatcatttttccacttttccactcacacactcaatacttaagctacacaatttcacatgtacttatgtgcatctcaccatttctcacccatttatcttggcttcttatgttccctctgcctagaatgtcctttttaaaattcatttaatacgtttattgagtggctacagggtgccagccatcattctggacaatgaggatacagcaggaaggaggggaaacaaacaagggattccctgacttcactgagtgtaactgcctttatacccctttattaacagcagacattaaatacatgatttcagtaaaacacaatgtgtgttaacataaaggaagtataaggtgtcatgggaatgtggggcaggagcctgaatctggtttttgggttttggggagagtcctagggaattgcgttctaaagccctctgctactgatacaagttctgaaatcagcaaggcaaaaagagatggtccctagaacctggaagagaaccatcccaactctaaaggttcttcactcccaaaccttcaacatcctctttcaacttgtcctatcctgagataaagcaaattttggaggggccactaggaaacttgtttggcaatagcaacatggtgcttagataagaggaagagggccagaggaaggattttgtgtatagtgagcatgaatcattttatgattttatttcatgtactgtatggccaatgaccagaaataaagctcaggcacctacattctgaatccagtgcttcttttttttcttttttgagatgaagtctcgctttgtcacccaggctggagtgcagtggcaccatctcagctcactgcaacctctgcctcccagtttcaagcaattctccctgccttagcctctggagtagctgggattacaggtgtgtgccaccacacctggttagtttttgtatttttagtagagaaggggtttcaccatgttggccaggctggtctcaaattcctgacctcagttgatcctcccgccttggcctcccaaagtgctgggattacaggcatgacccaccatgcccggcccagtgctccttcttgtggtccccctacacggccagtgtttttcaaagaaaatcatttcagagcaatccagattaatcataaactcatagccagaacctcttcctctgactccgcaaatctacagcaaaatggataagtcttctaaaattgacctcagccctctttggtgtcccctgaactccagaagactgagcatctggtacatggtagcaattttaattaccatccagcatggaggatacatcctcacacttggttatatatttccttagacttgttttccaaacatttgtctatcagccaacctacagatactttgctgagtcccctttatgtgcctaccactgttctgagtaatgagaacagtaccaaagaggtgcaaggcctgacacacactgggcactcaatggtgtctattaaattaataaaatcggccaggtgtggtagctcatgcctgtaattccagcactttggaaggccgaggcgggcagatcatctgaggtcaggagtttaagaccagcctggccaacatggtgaaaccccatctctaataaaattcaaaaattagcccagtgtggtggtgggcacctgtaatcccagctactcaggaggctgaggcaggagagttgcttgaatccgggcggtggaggttgcaatgagctgagatcacgtcagtgcactccagcctaggcaacagagtgagactccgtctcaaaaaaaaaaattaataaagtcaggcatgattccttctgtcaagtatttaacagctttttctctcaaatgggtagtatgcttctcaaagttaaaagccctgtcttctactttgcattcttattgcattaggttctctcatttggtacacaataaatgctttcttaatgattgaagaaaatgtttggctagcagtaagattgcaaagaggtcctaaggaggctcaagtctttcttcttaaggtcagcagtaaaaataaaacctcacaataaataaataaaaataaaagcttacatactgttcaaaatgtgcttctacattctcttgttggttccaagagagcaggatcatatttgttctgttcaagaccgaataccttcagaatgttatagacattcaatttttattgttgaatgaatgaatcctcataaccactctgtggggtgattgttattgcctgtgttttgcagaggaggaaacatataaaagtgattcgttcaaataaacaattaatgggggaagaaccagggcttcattccagagtttctgttcaagtctggtgcatgccagaaagtttcattccatctcccctccaagagtggagctcatcaattcttagaccttcgagaggacttcccagtggagataactctggtgtaggagttaggggtatgtgatgtctgtaggggtgtggagtggatggaggagttgcagaagagatgaggggatttcagacaaaggcaagactgcatgaacaaattcattgaaatgaaaaccagcatggttttagagtacaatgagcagagcatggaaggagagtctgcatagcaggcaggagcagattgtggagggctttaacagccatgcctaggagtttggagtcattctcaacccacatgataggccatgcttagtccattatttgctcctgagggcctaatctgaagcctccaaatggggttggggatgtaaaggactgcacaattagtaatgtccatgcttgtagcagtcttttagtagtggctgcagcatcaactaggtaggctgcagatgacaggtacctcccagcacacttgctgtgactgcaccctcgtctctcctgcttaagaaggtatattgctagtgagtgaggccctaccatagggatgccttgaaaattctcttctttctcttgattccagttctgtcctgtggagtcacacataatagcctttctaatatagtattttacaataatttctgtgtcccccgagtcagcagctgggccttgggctgaactgtaaagccttggaggtctcacacacctgagaattagttgctctacaggccatgtattctctctcccactcaaccctgagctctttgaagacaaactgcttttctgttcatcattgtattatcctcctgaaattccctccaccccaaaccccttagtgctcaataccacaccctgcacagtgtggtatgtactttataaaaacaacgatggatgaattgatagcatttaggtctctcaaaacacctaatgccaaattgatcaaggcaattatttaccggttgctgaagaaaaggatgagaatgcacacagaggccaagcaacacgttggggccatgctgcatgtcagtggaggggcctgcctgggaagctggcatagggacacctgcccagtgacgatggtgaccagaacaccagggagatggaagccactgagtgtttcttctacctgtgacagagccgttctctcagcaggaatgaatgtgtctcaagcagaaattccatcactgtggactactctctcactgcctcctcccctcatagtactggggaacttatccaagcttgtcaaaattagatgacaagaccactccacagagtctgagtctaattctggacaacgacacatgttctggacagtatctaacagatctctggttctccataaaggttgttattcatagtaataataacaaccccctgggcccatgctataattccactcaccatacagtggaatgtggtgcagggcagagttcatttgcttcccaattaagaaaattctgttgtgaaaggacccaaagggcctcactgaaaggctgcctgagaaatagtatcatatcagtgcagtttagttcagaaagtgcttatcgagctcctctgccatgtcagacatcaaggtagctttataaagcaaagcaccaagcataacctttatgtcagaagtcttttgtaccttattaatttgtgtacatgttttctgatttcctctcaccccaataatttctccttaaaatgggtatgtagggagaattgcatgagaaagtggtcttgatcctcagctacttcagtaatctttgttatcctttgatattcccaactacgtcttctagtttacccagttacacacacaaaaaaagaatttggatctaggtgataataataataatggaaataaaataacactcactgacacctttctatgtgccagacactctataagtgtctttccatatctgttttcatttgattctcacaacagcctgaggaagtggggactattctttttttttttttcttgagacagggtctcactttgtcacccaggctggagtgcagtgacacaatcacagctcactggaaccttgacctcctgaactcaggtgatcctcccacctcagcctcccaagtagccaggaccacaggcgtgcaccaccatacccagctaattttttgtattttttttttttttttttttagagatggggttttgtcctgttgcccaggctggtctcaaactcttgggctcagacgatctacccacttcggcctcccaaagtgctgggattacaggcatgagccaccatggctggcctctcatcttttgttacagggctcagagagggtaacttgagcaagatcacactgctagtaagagctcccagctcatctgacagcagtgtccctgccttgacaactgtgctaaactctatctaaatcacttgaagttccttctttggaaaatcctaaccagtcaaaggctggccacttttatataagatgattgaagcaggaatgttcattgagatcattgttcggatagggagttgattgtaagtgactggtgctaattcttacatttaggattttcattcttttcctgatttacatttggggtaactacttcagcctcaggagaaatgatcaggcatgtgatgtaactgtagctactgagctgggcagtgtgggcaccttcctcagaattagaagtccactgagggccagcatccctgaaccttgttcattgtagaggggaaaggaagatagagataagagaggagaagagatgagtgagatgaagtactcacttcagtcttcctcctactctggccagtggcaccaatggcagataattaattcctttttaaatttaattattttattctggcaagaacagatgggtccactcagagacaccctgctggcagacagttgtttcaaagccaaggaagtagaagggagtaaagtgcagaaagagattcgtgctaggataaataattttcttaaactgttggaagaaaaaatatgaaaagtgaaagaaagggagtagtaaatggagatattaaatgtcaacaaaatattggtaggtccttattaattgctccaagggggtaacttagtacccatgcaattaattactaatgaaaattataatacccacatttctttattattttccccatttgtcatagatttatagtgcagtagagctgaacggaatgtagagatcaatcaaactcaactccttatttttaaacaagatgacaagggtccaaggaagtaaagtaagagtgataacaacactaacttgagtatttcccatgtgtgaagccctttataactatactttctaaccctcccattaaccctgcaaggaaagtagtattgccccatttcactgatgaaaaaactgaggctcagaggctaagtacttgtactaagtgccacaactggcaaatgctgcataaagggtttgaatccagctagcctaactctaaagcccacatcctctctacgtctctgacaagagaaagaaaaccaaggactaggactgatagatgatgataagcccgtgcccagaactccagtctcttaactctcagagttatcatcatctatttttcccactttaccttgcctcagaagagacccagcgtttttccttttagcttctgccttactggctggccatcccttacatatgctgttcctagaattaattattacattggggccctcagcccacagtggtcaggattcccagactcttcggcctctgccatcatttggccagaattcacatatagaaagttatttccttttttagccagcaagtgttcttggctgcagcagtgtctactgcccggttcttggctggccaaacagcaggctctggtgttccattgatgtgaaatcataacaagaacaacagaaacagcgattattaggcggaggaacttccggtctctaaggactagtagggctaggaccctgcttgcatcactctctagtagtgtaaccctaggcaagtcacttatcctcccaatttctaactcatctaacaaataggaatgtttattcatggggataacgtaatgtgtggacatgtggagtcacctagaacagtatctggcatataggcactcaatgatattagttccttgttttcttttctgacatttccagtaaaaactcctctcagacatgatccaactagccaacttgatgcagaatctgatagtgcttcaggctggttagtgacacagcaaggaccctcatgtggcacaggtaaaagagggtaactgtcagagatgggaaaaacacagacaatggaaagtataggaatttgtctacaaattagttatctcacaaggcatccagacctcctgggtcaagtctggagaatcagggaggtgtagggcccaatcaaattaagccactctcattcctgtttcaagtccagcatgcctcctaatgtgtccttaactcaagattttgggcctggagttggactccacatggctccatattataaaatgtatgcctcatgggatgcctctcttctgagaagctgcagcacttttgaatctgatcaccaagcagaaggcacactcacaatgagaggtttgaagcaggctcagttctacttggaagagaaagagggggttgtctactctgtgatctgagggtaagggacatcttgatccctagccacctctgtcctctcctgaggttctgaatcatggagttgccaggttggagtaagattcgggaaatcccctgtgaaaatgcaatgttatcatttcatgaagagaggctcttttctggttccagctgtttctttgtgatcctagacaagatatttcccctccctgagcctcactttgctcacatgtgaaacaaaagtgtagaggctcttccatctctaagttagaacatctggggagtctgtgacttgcccagttgtgatagcatggcaagttagtggcaaagccaagaaacaagtccagagtttctgacttctagcttagaggacagcagaaggagtcctagaaaaaaaaaaatctgtggtcataaaaaaccagcaatacctccttggaattatatgtcgtaggaagcctttctatttgatagccatttaaaatatttaatcctcataaaaccttatgaggaagatatttattagcatctttggcagatgaagaaactgagtgtaagagacattaaataatttccccaagatcacacagctaaaatcctagccaaatgtgactccaaatgcccaggttcttccttcggccctacccctcaattagataaactctaaggtccctctgtgattttttcaatacctctcattctgcgacctcctgactctcagtggactgttgaatactaaattttacttgcccattatttactaatatatcagaaacaatttattctcaaagtgcatcaagctggcatcaccaggagccagcagcttccaacaatagtaaggaagtcagcttcctttccaggaaccctgaagctttccaggaaaatggtcatctctcccctttgtccagctcaacccttgagcccaggttggtgcttatgggagttcattcacacagagagctactggaatccccagtaagtgagtccttccctaggacgggggcagagctttggccttgggtctccctgtccctgaaaacggcaggtcatccagttcctgtcctgattgatccacatagacaggtcccctgtcctaagaggtggggtcagccagtacctgagagaccaggaggcactgtggcagtgccctccactgcctgtgccccacgaacagccagtgtagacgatgaagagcaggtgggcaggtgggagtcaataccaaaaaatggaattgtagagacactcaagtggaagaatcagggagactcagggagagatggaggctaggaaaatccagccgggggatggacattagaagagccctcggtatgagtgagcagggcagggtgctctcccaactcaatcagccctgactcactgtgtcgtctcctacgagtcatgaccttctctagtccttgttctccttatttgccaaagaaggaggctggtaatggaagagacctctttcagttctaatgttctcagaccttaggcagtactaggagaggggacaggagtgaggcagttaagatgtaagaacagtgaccagcttcaggagcccagcaagcacacctctggggttccaaggcagagacaaagcagggcagcctgattctgtgactgctgtggctctgtgaacgtcacatgtgtgggtgaaggatgctcagagagtgttgggttggaagccacagaatcccctcctggtactctctgctctgcagactgtggtcattgggactcctcactggcaggtgctgagtgaggaaaaggcttggagggacagccaggggagcaggctccaaacagctctgccgccgggcaacttggcaggaaggtggaaagttcagagctgtccctagagagcagtgaatcaagggctgggctgggcttggctgtgactctggggacagtgggtggaggggatggaggctgcttggcctgctgatgtaaaagtcaggttagaaggcctctaaataccagctggtgtccccagccatgagccacagcaccaggcagtcagaggcgctgcacctccacacgctccccttggtctcttctctccttcagttttgctggttccaggtcttctgactccctgttcggtgctctttgcactgccctgcctccccacgcagccagctggacctctttgcaccagagcctttttccagaaacagcagccccagtgatttgctggggagtgagaacaaggaatccctctattataatggaatactgcgagggagaataaggaaaaaactgagcaacagagcaggatgagaaattcttgtgttgcgcctccctttttcagtggttctgagttgcctttgagcctatggaatcacagcctcacacaccgttactgctgaatggaaccagagggaaccttctacttcaaattccccattttatagatgaggaaaccgaggcccagcatggggatgtgtctgctacaaggcctcccagcccctgagtttgggctctttcactgcatgctcagaagaaaggtccaggaagaaactaacagaatctttctaccccatggcctcctacttcacaccacaagtggaaaggagaccttcagtgggtgctttcctgggcttcctcgctggtttcacatgcctctttcctccggctgcaagtggcagcctggatctctcacatgtggccactgcacagcggggacatgatactctgcaggaaactaagcagggaatatttttaaaccatccaacatgccttagggagaaaaaaaaaaaaaaaagcaaaacactcccctagatgctgctaaaggcattttgaaaaagattccatgcctagcagaagcatcgtaaaacagtgttggttttatttttaaagggccaattccctctaagaaaagttcttgggaatggactggtgacccacttctaagatgcccccagaggactgaactccacaaaagtaggctggaaccccaagggccctccactcgcaattcttcatctccctctaaatcaaggaagtaatttatctgctgcttcgctaaaccttcctttttaatatatccatacctcactatcacaggaaatagcgggaggggtaaggaataaactcacaggtagaaagaaagagctttgtttttatccagcctagaatccaagctcccttcctctggctacttcatatccacttgtagttttagctgttcaaattcaagtctactcttacctgcttcttttcctcctccctggactttccttccgtgggcttcttcacactctggctgcttcttctccaactgcccacgctttttgctcttgagcctgtcagttgttcctcttccaccgtctttttaatcgtatctgtcgccttccctcctcccacttcttcctactctttctctctccaccccttttcccctctgaatccctccctcccctctctctcttttgtgctcttagagtctttgctctaaaagtcttcttccctccacctcctcgtagcctcagctcactgtgctccccttccctggcccccaaggaggcagagccccctcctccctgcagccctccccctgtctgtctgcctgttgtccttgtcctcacagcagtcctccacattgcctctcccccgggccgctggtgcaccacctccctaagtctcttcctgcccacccctctgctgcgtcgcctcagacttcccaggccatggctttcctggagcatcagcaggaaaattggcactgcccaagagatccctcttcccatccttttcccatcatcagaaaaaagagggtgttcactcacataacaagccttttttgggatttccactatgcccacaccaatgaactaagcataagccagcacaggaaaacacggtctcacaagtcacaaccatccagcacccagaataggcaccaggactaacctgaaaggaaagaaatgctaacctcccagctccaaaagtgtagggcattcctcactcccagaatcatactctctccccttctcctctaaagagaggcgagcaccttctacgcatcaggcactgggctagagacttcatatatatatatatatatatatattgcctatttttatcttaatcattctattttccaattctataaggtagaccttttctgcattttacatttgaggaaactgaggttcacagaaattaagtaacatgattatggcgacccagtttgtaaagtaagtggtagaatcaggattagaagttttcaccaatgccaacatttatcttattgctccttccgtgaaagcaaacaggtctcccaactggaattgaactgatgaaagtaaggttggctcttgttagatcacatgccacaggtgaccaaattcagaaactgtgggggtatctcttccctcaaaccctcccattctccaacttctcccccagactcctcaacttaaacacttagccgtggacccagttggaatgaggtaagtgtcaacaacagaggttactatgagtggactgaaatcagacaaaacaatgactaagagcccacagattatgagaactaaagaaaatttcagtgatcatctggaacagccagggaaactgaggcccagagaaaaggccacttgtcaatgtcatatacagtagtatgtggcagaggcagggcaggaagccagaatggtccctttgctccacatcatcacctgaaacatgcctttcccgcaaagcaccggtcacaagcattccaagattctgcaaagatgtttccttaatgggctatatttttcatgggtgaatgagcttaggatcagcaagagggaaaagagcaaggggctgaatttccagtttcaagggaggcaacagccctggtgaaaggaaatgtaggattcttgattccttggccagagtttaccccacttttatgcagcatcagagcagattctggggccagcctgactgggtttgaatcccggctccgccacttactagctgtgtgacattgggcaagttaacctctatgcatctcagtttcctcaactctaaattgggaatattatctacttcacagggctgtcatgaggactaacgagtatgtgaaaagcacatagaatggttgggaacatggaggtactgtagatgtggctgcaaaataataatacaatacaatacaatacaatgcaatacaatacaatacaatgcaatgcaatgcaatgcaatgcaatgcaatgcaatgcaatgcaatgcaatgcaatgcaatgcaatacaatacaatacacaacctcctccctgcctgtacttgccatggctgtaccaaagtcctgtgatggaatttagcatgtgaaaccaatagcaagccctgcttctccaaaacagagatgagtttcacactgtgactttgcccctacatcccagcctctctacaagagcaggggacacctaggaacaccttattatctccatccaggaggtagccagttaaagaacccataaagtctcagctgggagatagtctgaaagtgggaaaggtttagtggaatgtacactcctagatcactgggctgccagaggagagatgatctcgggcaggcctggagattacaggaaaatgccgttttcctctgaatgtgcagaagggaagagctgcccagatacagacacactcatgaccctggagggagagcagggtatacaaggtaaattttcccttcgtgcttggctgacagagaactaaagcagtgaagaaactggatggcttgctagaaaagtccaggaagttcgcctcagggctgggagaaggctgaggtctctgactgtgatcatcccaagtcaatgaggtcaaacaactctccacccggggaccattcatcatggcatccaggacagctacgttgcttcagcaagggcttcacaaatgtggtttattccgcacctggctcaggcaatgactaacaaaagttgaaaaaaaaaaaaaaaagtcatttgggctgtggatgtgaggtgattctctaaaggggcttaacctggcaatcaccacatagctaagaaggaccccgtaagcagatattcaatgcaccagagaaaaggacaggacgagggccaagggtgggaactgaggttctcccatgccctccccttcttcctcatatttcacacaagaaacggtcttagaaagaagtatcaaagtctgtgttccacgcattacaaaatatggaggactcgggatttagagaggaagcccaaatccagtcaaagaattagtaaatcatacctgtaaggaaaagctgtagaggtgggattgcaaaataaactttattcaacatttattacatgccaggcattgtactaggcacatttcacattcttttactttgagataaaaagacagaaaaatgacgttataaagcctttctcactataatcagtgtcttatctcaacaggaatcattggctactcctatgggcccagcctattctatgtgagaaacaagggctctccctgtccacaaggagctgacattctagttgtagaaaagagctattgagacaaaacaattagtataaagggtagtatcctatatgtatgtgtgtcagtgatggtataatgaagtgctaaattatgtgagaaaaaatcatttgggaaacagcttcgtacagagtgatctctttgttgtgctataatgaaggggaagaaaaagcaacattttttatatttaaattaaatttatttattttaatttcagcttttatttttgattcagggggtacctgtgcaggtttgttacctgggcatattgcaggatgctaaggtttggaatacaattgatcctgtcacccaggtagtgggcgggtagtacctgatggtttttcaacttttgcctctctccttccctcctccttctatacaatagacactactactccctagtgtctattgttgccatctttatgtccatgagtacccaatgtttaactcccacttagaagtcagaacacggggtattttgttttctgttcccgtattaatttgcttaggacgatggcctccagctgcatccatgttgctgcaatagccatgattttgttctttttaatggctgtgaggaacatttattgaaggccttcagtgtaccaggtattttcacctcacaacactgtgagatagatagtatgttattatttccatttcatggaaaagaaaattcaggctcagagaagtgaagtaactttcccaagatcactcaataagtacagaaaaggttcacctggtgcgaaagattaggcactttctccccatggctgtagaagaaattctcatgaaacctattggcctggtaagacaggcgggcacagggccctccaggtaggagcaaacagacctgcagatagcacaagaagaatggactccaaccctaggagaagagattgtattcagccctgattatgaaggtggttcagcactgtcactgatttccaggaagaagcaccatcaccttcttcacaagtcttttaaaactggcatactgaaaattgcttcttttttttcttctctctagtggcaaggggggaaatgaggagaccttccaatgtcttctctaccaagtgaatctctgactctacaagtttccttcccaagacactgtggtccagggctacctcccttacagcctacatgacaacatgtgcaaattatttgtcagcatctaattgcaagaacggtgagtcctccgtgcctcattggaggccataaatgggtaattggagccatggttagtgggctgaggtcacacttttctgctggttaagatgcagacaccacaggcataagccgtcccctttaagacttttactggctaaaaagggcaagaacactctgttccaagaagcagaaagcaaaagaaacacagacttccttgctcctggtgtttagatctatgagcctactcttatcatatctcaagttttaatcccaaagacaagatcaagatcatgtccatacttcttaggcttaaggcaaatggaatcttctgggatcccaggcttaagaactcttgtggtgggcttggaacaatagcctccatggacaggagaaaaggagagggaatccactaccaaccatgcctaattctctcccactgaagtcagggcatgaaggcaacagctgagtgcagcttcacttgagctctgagagtcccaggactggggattttaatctttctttctttctttttttttttgagacagagtcttgctttcttgcccaggcaggagtgcaatggcacgattttggctcactgcgacctctgcctcccaggttcaagcaattctcctgcctcagcctcccgagtagctgggattacaggtgcctgccaccacgcccagctaaattttgtatttttagtagagatagggtttcaccatgttggccaggctggtctcaaactcctgacctcatgatccacaggtgtgagccaccacacccagcctggggattttattctacagcaaaaaattagaccttggcctgggagatcttggaatggcatttgctctctacatccagagggaaatctctgaaagcaagaagactgagagcctcatattttggtctgattataagcaaggtctagagtttgtagtgcacccctggtatacattccttcctcttctaacaacttatgcatccttgatccacactccctacctacctcacaagaccaaaaaggtcttgcttttcttttattttgaaaggtgtttcagtcatgtccaagatatagtattaggtggtctattgaaaaaaaaaaaagtcgtaagacacaagatcaagaaactttctgccaaatatgctgttaactcagacaccctcagacatgtcactctgaaatagaggtatttccttgtgtgtaaaagtgaggtacaataccctgtacctgtcctgataatttagccattgatgttcaaagcctaattcaataatgatatggttaggctttgtgtccctacccaaatctcatcttgaattataatccccataatccccatgtgtcaagggagagaccaggtagaggtaattgaatcatcagggcagttttccccatgctgttctcgtgatagtgagtgagttctcatgagacctgatggttttataaggggctcttccccctttgctcagcacttctccttcttgccaccgtgcaaagaaggtgctttgcttcccttcaccttccgccatgattgtaagttcctgaggcctccctagccaggttgaactgtgagtcaattaaaactctttcctttataaattactcagtctcaggcagttctctatggcagtatgaaaacgtactaatacaaataacaaaggttttatgtttcctcccaaattagtgtctagagtcaacgttagctcctagggtcaagctattatacaggattagaggcatttaggagattacaacttttccctggtttttcaaagattagtcacatgttcacttggctgaatacacaaggtagaatggacaggacttgaggcaaataaccttgtggttaagagtactcaggttcagattttggctccaccacttggcagcaatgtgaccctctatttctatatccttcttgcttttaaaatgagtataacaatggtagtttttggttggctatgaagattgagtgagatatatgtcatatttggcatgtagtgagtgctaaatattctctatcatatatattgtatataatatacaatatatacctctctatatatacatacatagctagatatacagagagatagatatatagatacaacgaatcatgccatttatgctgaagataaaaattaaattataaatgggagagtactctgaaaggagataagatttcacaatggaaacatgggttctgatgattatagctctaactattgtgcccaccttcattgcctcctttgagcaaggccaccagatacagccaagcagtttgggcactgcacacatccaaaggcaccattcacatataaccttccctttgtacctgagagcacatggcaactactcttcaggtaagcctgtgcttccctcacagttgttcctcccagagtctgaggaacagcacctgctctatagagccattcactcattagtccttaattcagtgaaggtatactgagaacatactctgtgcaaggactgggcatacaaagataaatgaaacacaaactctgccctgaagctcctggtggctagggagagagtcctgtgcaccaagaagtagaatgcaatgtaaagagtgctaaagtgcatctatgtacaagagattcgaggattgccagctttctttctacatggcagtggtcatggacaggggtagtgtggggattcacagaagcaaaaatgagacaagtctaactctcttaaaaaaaagttctcataaacaccatttttaaaagtcaagaaaaagtcaatggggtacagtttcttcagagaaatccagtggggatcttttgttgtggcaggaagggactctactaagaacctctagcagaggcacctctggtagaaggaaggtgcaaaaatagctcccctaataccagcccagaccagaagaaaggacagggatttatcactcatacagcaaatttgaaatgtagattcttacctaacatgaagattcccttctcaggggatagaccaaattcccttctcgggggatagaccaaagcccgccagctttagacagatgccttctctttgcatcttcatagcctctttgagagaggtgaacttggagtcaggagatctgagatggaattttaaccttgtccatttgttgttttgtgatctcaggcaagtcaataagcctcaactttgttgtcataataagaattaagaatggtcataataagatggtcttcacaaatttgttctttggacaccaaacaccttagttattgtcatatgctctgggatagaggtgagatcttaggaaggaggcagagacagcacagaagtccctccattcacaaacagggtctgcccaccatcctttaaggagcctctgcagcttgtttataaaggagatcttgtcctgagagcattatgctcctgagctggccagctcagcccttccctggctccagcgccttcatttgtaaagaaggaattccaaggctatcaaaaaggaagtcagattgttttcggaaaacaatagcaaagtaactacaagtcattagcttcctctttggggcctgaagtcaagcttgtctgggtagctgaaaggaccggtagcactgtttacttaaagacctctggacagtacctataaattaattcctgtgcatgactttctggaatgagaggaggtgagtcatggaagtgggaggatgcctaagagtagagatttctgtttcttaggacacagctaaatctctgatgctggccttgccttttctggtcctctgggtgaaagtttcatttggatatgtacgtgcacctaacagacatctgctgtctgagatggctcttaatgagtttttttcctagagcaaaaagaaaaacaacaaaatatctgtttcctgtgggtctcctgaacgcctcgaggaagccaaatgcttctgagacaggtgctgtagaaattgccttttgaacaggaatttcctcagtgacaggagcagaccaaagctgggaattgtgaaattcatcactccttagaggactgtctcagtgtcatacagatatcaaggaatcacagataccagaacactggagcttgaagagaaactgaagatcaagtgggccagatgagaacattgaagcccagagaaggcaagcaatttatctaaggtcaggagcagaagccagatctcccaaagaatcaggaaacctggggacttccctgagggtagaatgggccagttattgatcatagatattcctatgatgctgttagagcacttagctgaaagtccctggagcttaaattactaaaatctagagaaaaggcatggtttcttgacctctctagatcctggaacagcttgtatccaagagctacacatgattctagaccctaaagttttctgagaagagatgcaaaacttctacttgagctgtttttaaacatctttggtaaaatcacgaggatctgttgagcttaatgatttgaaatttagtccaaagattatcagtattacctgcctggacccctagaagatttttggtgggcttcatggagcatagaaacccctgtgttcatttcaaagctttaggggaagagggaccacagtcttgatctattcataaagcactcttgacccaaaaaagattaaaagtcactgttctaggtataggaggtcaaaaaagattatttcacatcaacctccaaagtaattgaaacaaccaccaaaatgccaatatgttctatcccttccccaacctagaagcctcttattgaacaggttgaaatctgttccataggcataaggccacttctcagttcagagtcttcacctgtcaaatataaaaaggttttctgagataagcatgcttattccttcctttcgtaactttcccaaactcaaacagctagccaagactggcacctctcatcatgcctagtccagtattctttctgccacctcagaaggtttttaaggatttattaagcaccatttctagatggtcctgaaatggtcccaaatactacaggagctataggattacaggaactgtccctgaatgcaatacgtttgtaaatgtggtaggtaaatgagtgcatgcccctgaaatgaattatttccttaatgcctttcccaacagtgtggacaagggaagtgagactggaggagtgctgggggagacatgaaccctggcataactgccccatccctggacaactccagccagcttgacaatcaatgagcagtaatattcagtaactaggtgccaatttctaagacccctccgatcttgaaacccctttgactgtgtgctgggttaacaaataaagcataagccaaaagacttgttcaccagtttgtaatctactacaaaataatagagatttttcaaataattagtgaataaaggggagggggcaagtaagcaggtctccaaactgaaaatagttgcatcctaaaagcttcaatgtaaattggtggtgtggaatttggagcatgttttcccatagaaataatgttataaagagtagttagcttcccaggctagcccataaaagcttatttcaggcataatgttgctcaactacagtgttgagagtactagagaagctaacaacctagttaacatggtctctggatgggagagaatgatgccaagttctggctggggactccaggaatatatctccctctgaagagtttcagattcaagcgtctccactccatccctgcaatgaggatggcgtcttcctgtctccctgtcttcatggggaagggaaataatatttattgatcacctaactttattaatgcaaggactgacccactcagcattgtccctttcataaactaatatccgagaccaaccacagaaagaaagctttatatttttcaaactgttccagtcttttcctaattagaaaaagtaatagcgtattattgtaaaaatgtaggtaatatagaagagtctaaacatgagataaaatcacatataagtactattaaaatactgatagctttctaccacatttttgtacttataaatgtttttaaaaaattggaattgtattatgaacactttttggtaatctgctttttttcacttaacgatgtgtcagagacgttttctatgtcaatagaaatacatcttcttcacctttttaatgattatcaggagtgtagtcaaagagaatggcacccaaaggcaatgtaatgtgtttgtatcttttctttccataaggatgttaccactgcactagaattatcaaggactagtatctgtgcagtactctttagactaatgtcagggtatatatatcacctccaccctttgctaagtacctgggttacacagtttcctgctcttggatttaccaaaattcatttaatgccctattattgagcacttcaattttgggtgaatataaatatcaccatattgaatgtaagtggtgcccttttaatttctaagacaaagcaacttgctgttaacccatttctttctctgccccaaataagttactccatgtaattctgagctgtcctttcaaagccttgcaaacagctcatgggaaaaagcagaatttctgaacaaaacaattcaaaacaaaacaaaaaatactagcttcctccattcaaccaaccccttctctaccatacacataagacgcaaaaggaagtgtgctgagcgagtggtgaaacactagggcagataagaataatcttgacaggttcggagaaaacccctcatgaatcttgggagaagatttctatgggtaaatggggtaaaggttcaaatcctgaagggctaaaccaaactttgcaaaagctcaccaccaccacaagcctgttaccccagaacagccagctgtgcctcatgcctccaatcctgctctggtttctgtgaattcacacacaaccctgggattgaagtaccagctctgcctgtggtgggaaggacgtgtgtaactgacaaaagctgatgaggcagagagggaccagggaaatgcaggaatcaggtctcaggtcctatctctaacacttaaagaattgagtgcccttgggttaagctacatcaactgtgccttctacttttaaattttaatatctctatgattctaagtaattggttatctccataccaagccaaagcttggaagaagttgaaatttgtcttaagtgcccaactgtatttacacttgtagctcctccctttctttacctatacagcactctggggagcatgagagatattcttaggccattttttattccagatggtgctgcggtattgaaaacttaagggtattccaaataaggaaaatacaaatgagcaacacttggaggtgtgtttcaattaggatgctaccagccatcagtaacagaaaccccagctggagtcaaacacactgaccactacactgtgggaatgcacagagggtgtcaaagttaatggatggcccacttacagctgatccatttatttattcatttattcatgtatccactgattttaaaaacccactgagtttgggactgtgctaggaactagatatactagtgattcagacatggcatctgaattaagaaatcaaaacctaggggttttataaatatcaatgctccctgacccctctgagagctgagtgatgtcaccaacttagaatcccacaagactagctggagacctagttggaataaaaatgctgccttgttttagaccatcaagtctatgataatactgcgatttccaggaatctatctggattgagggagctaggcaatgcatgctgacatggcctgtaaaagggattgaggtggagctctgatcgcaggagagtatagaatggaaaccagaaactaggaaccatggacatctgcatctattcaccctccatacaagggggtgtagggagttcccatttacctccaggtctggtttatgaactgtgggcctgcaagcagcctaaacatgattgttgatgctccagtggacctgaataggcagggaccatgacaggtggctgcaaacagataatagagagctaacagagaatgccaggcagtggtctaagtgcttagcagagtttgctcatttaacccttacaaaactcttggagataagaattagtatccatatttaacataggtaaaaaatcaagaacagaaaccttatccaagctggtcagtggtagatctgggatttgaatccaggcagtctagtttcaacatctgtgcacttaaccacaaaataaattatatgactatgtgagaagtgctacaatagagctacgatcagaatgctgtgggaactgagaaaggaatgaaagtgccaggaaaggctccgcataggagacgacatttgtgatatgtcttgcaaaataagtagaagtttcagacagagaactggaagtgggagaagtacatcccaggcaccatgggacagatgggcaatggcattttggaagactacagagtagttcttttgcaggagaggtgagccccaaatctggggccttagctcaggaaggtttttggttttgctccagaaagaattcaagagtgagccagtggtagaagaaaatagctttatggaggtggcagtgttacagctctgtgacggctcctgcagaacggggctaccccacaggcagtgcgctgacagcaggagctcagggcagttctacagtcatatttacactcacttttaattacatacaaattaaggggcaggttatttaagagatttttagaaagggggtgataacttctgggtcattgccatggaaaggggcagtaacttctgggtatcgccatggcaatggtaaactattaaggcactggtggacatgtcttatggagcagtgcttcccgtgcctcttccctgttttagccagtctttgatctggtccagagtcaagttctgcctaactcaattctacacagctggaccaaaaaggatgggggagtttggtttccaaagaatcctgagtttggggccagattgttaagaactttgtaaaccacattaatttgttctgcaggcagcagggagccaagtaaggggatgagtctgaatcctcctacggttttcagggatttccaggatggttcctcagtatgcgtgtcctggatcacacccagtgctaagtaaaatcatttctctggccacttgtttcttgcttttagtctcttcagcattgcaggtagagcccagggctgggtaactttactcctactgacttggaaagtgaaggatgcatagttgctcaaaggcagagcatggcagggcactctaccagtgttccacctcagaatcttggaccattctttcacctgggagccctgaattcaagaaaatccaaatggagaccagcaaaaaaagggaatgctgttttatggagatttttaaaccaaggctgaggggccattttcaagggatgctgactcagtaaacgttctttggcagcaagcatcagaaaacaactgtaactactttaagctgaaaaagaaaaggaagagaaagaagtgaagagagggatgaggaggacaggaacaaaaaggggaagaaaggtgaagagatttccttaaagtctctgcaagaatctgttaagaataagcccccagttagaagctcccttgggcttcaaaaacattagaatgaatagatataacttgactctccctaagacatgattcttccgatttatcagtctattatctttctctccaggacacacctgcagccttacaaaacaatgagtctttcattaagctgtggctcttcatccaaaagttcccctacttataagcagaaagtctataagtccaagggctctcagggcacctgcttttaagtgtctgtggtgaccattgagaagggggccactggaggccctgcggcctcaagggcaaaccgatatagtcacaggaataatcaaacagcagcagaaggcttcagaacaagcacatcacaaaaaacactgaactcaactccaatggaagttgcgtcacttggtggctgtgtgattctgggcaagtcccttaatgtctccaagccttaatgttctcatgtataaaaagggtgcccctttttgtaaaaaggctttctgactgtgacaaattcattaaaatattgtgatgaacaaatgtgttccaagctgcaatgtgccaggcaagtgatgttattatcaactagactcttgctctccatgcagtgaagcctcttcctatgagtggaaattattcagccttgtcactggcatgtcaacaaccagacacagcttagcacagagtcatgccataggtctggggcaggacaagccaagtgcaggaaatgtgtctggtcagcttctgcacaaccctggatggaacgggccaggggaaggggaaatggtttgccccctgcattctgcccgtatgccttcctgtgccatcctccagaccccaggctctaccctcaggcctgggcagtgggataggctccaagagtctggagtgtctagggctgggtgagttgggtaaactttaacacaaagccttataaaatgcttgtttgtatttcacttttagtaaactaaagaggcaggaaagttgaagacaggtttggatctttccaagaagggcttggcctcacagggaagaggtctccagatgggtcagggggaagcagggcatatcgagcctgggggaaagagggatatgaatatggcatctcggttttcaaaaagttggcatgaaaaggaagatttgacttattctgggcagctcagaaggatggaactgggatctgagtgaggacggggaggaagagggctcacattaacttactcttatcaggcactgttctttacaaatgttatgacatgtaatcctcacaacaataccatgaagtggttactattattatcctctgttttacagatgaggaaaccaaggcacagaggttaaacaacgtgtccaagccacgtagcaagtaaacaattgagccaggctccaaatccaaacgttctggcgtcagagtcctataaagatttttttggcctaatgtgaggaagtactttctaagaataagagtttaccaattaaaagggggttgctgttttatgaagatatttaaaccaaggctgaggggccattttcaagggatgctgactcggtaaaagttctttggcagcaagcatcagaaaccaaatgtaacaactttaagctaaaaaataaaaagaaggaagaggaagaagagaagatggggttgagggaggaggacaggaaaaaaaaggagaagaaaggtgaagaggaaagtgaggaggaggaagaggcaaaaaaaggggcatttgttggaagtggggtgcagaaaaaataaacagctgaagattcaaattcaagaaggaccagaaacaaggactgccctaggatccagggagcaggaactgattaaccgtttctttagggcacaattacccaaataaatcagctctaatggatttctgtctttttgccattctgcttaagattcaagttccagggaaagaacattcccttggcctagccttgggaaagatcgacaataaaaatcgctaatatttatggtgtttattctctaccagccactgttctaagcaccacatctgcatgtattttcttctcacagacaccctatgagatagctactattatagctaagaaactgagacagagaatgttagctgtcattcaacgtgaggcagtgtggttgccaccatgtttgctctaatatcaaaatggaaaggataggctccctaagacaaaatgttgatgttgatgaagaaggggaatggatgctaagagataaaacccacagatgctctctcagggcttggtcttgctagaagggaaagagaggactcccgaggtgtcttctgacccaggaattctacattctagtttccatcctaaccctcttggttattgcaaggagaagatgaaacaaagcaaggaggccgggtgtggtggctcacacctataatcccagtactttgggaggctgaggcaggcagattgcttgagtccaggagttcgagattagcctgggcaacatggtgaaaccccacctctaccaaaagtaaaatttaaaaaaaaatagctgagcatggtggcatgtgcctgtggtcccagctactcaggaggctaaggtgagaggattgcttgagccccggaggtggaggttgcagtgaaccgagattgcactaatgcactccagcctgggcaagagtgagaccctgtctcaaaaagaaaaaaagcaaggagcaaaaagacaacagaaaagatataacaaaggactgagtgcaacagaaacataggagaacaaatagttcctgaacaggatacaaccaaatgacaaaattctgagagaaaaaaaaaatgcctatcaaagtataacttgaaagacaacaaagaaaagattccaagtcctataaaagtttgagaatgaaataaaatgaagaaaagcagagaggccaatttctcacaaatagtgaaaacctgatgtgaaactctactacaagaggttgcactccatcatgattcacaatgaaagtttggagtcaggctgccagaattaaatcctgcctccagcacctccagctgtgtcactttgaaagcattacatgacctgtctgtgcctcggtctcgtctgtaagattttaataatgcctaattattaaattaacaatttaatagttattaataattgttagtagtgtcagaggagtgttgaaagggtaaagtcttaagcacagtgcctggcacatagcaagtgcttactaaacgttagccacgcggccactgtatgtgagctcctacaagcccaacatggtcttgggacaggccgacaggttgagtgcctggaagaaacccctcttggggaatcataagcagagacccccgaaaagcagagacctggtttctgcatgggaggtcaggaaagcggcaccaccaacagatgcgggtccttagcagagagatgagcaggtgaggagaggaaaagcctcccaggagttgagagtctggatagtggaatgccagaaatgaagctctggaaaaacattctacttaaaatataattgtaagaactcctctttgtagggctctcggagaaaccctctgaaatctccaaggagttggagaaccggaccctgggtttgcaatcaagagctctgtgttctggcttctgctgatgctagtaggctctgggtcctttcagggtctcaacttccttgtctgaaaaagtgggcataatggtatctacctcaaatgattgaagtgaagattaaatgaggaatgtctgtaaaacacctggaacataggggctactgaataaatgataactttccttacactctcactcactgttacaaaacaacaatgcatagaacagggtgtccctggagccagaagaataaagtaagtgcatgcttgttgaattcatcaacttccagaatgccccatgtgttctagtgaatccatatctgatatagtttggatgtttggcccctctaaatctcatgttgaaatgtaattcctaatgtcagaggtggggcctggttgggaggtgtttaaatcatggggttgaatccctcatgaatggcttggtgccatccttgtggtattgagtgagttctcactttatgagttcaaatgagatccggctctttaaaagagcctggaatgggccagacacagtggctcacacctgtaatcccagcattttgggaggccgaggtgggtgggtcacgaggtcaggagttcgagactagctggaccaacatggtgaaaccccggtcctactaaaaatacaaaaattagccaggcatggtggcacatgcctgtaatctcagctactcaggaggctgaggcaggaaaattgcttgaacccaggaggcagaggttgcagtaagctgagatcatgccattgcactccagcctaggggacagagtgagactccatctgagaaaagaaaaagagcctggaacttcctcctctctcttttgctctttctctcttgccatgtaacacacaggttccactttgccttccaccatggttgtcagttgcctgaggctctcaccagaagtagatgccagcactatgcttcatgtccaacctgcagaactgtgagccaaacaaacctcttttctttataaattacccagcatcacatattcctttagagcaatgcaaacagactaacagtgtccttagccattctcacaatctggaatgatctctccactccattccatcctaccttgatctattccctatctagcaaacatcttttatctttcaaggccaagctcaaatatcatgtcctcaaggaactgaggaacttcctcagcatgtgacttgttcttcagttttgcactgattcccctgtactttgtgttgtaattagttcttgtagacagagagaatgtctgactcaacttggtgttagtctaggctgcattgcacattcttttgcggcattttacttgtatggggttatgggcagcagcatatccctgaattcacatctccatctgaattaacacttagtccctccatttaggcctcaatcaatactccccaagaaagaaggaggggattatctagtttggaaacctgggtacaaggactaagcatgcagggccgacttacccatgaagaacagtagctagagtccacaatacttttaaaggcccgcacacacacaaaagcattcaatttcttttgaaatcagtagaaaaaataaaattttaggtcaagcaaaatgttttaacatataatattaatatatttatctttatgccaatgcacatataatttttaatatttttcatggaagaatgagcccatgaaaccaacagtgcctatgacccaccaaagtcacacagctctgtgggcataagtagctcatccttttctccccttcctcctagggagctgcctgcctagaggaaacagggagcctttagcctgctcctccaggctcaacatttgacaggggcatgaccatgtccagcattgctgagtaactgggaagagaagcccactgttgctgcacaccctacgccaagccttcaaacagtcccagcagtaatcaaggtgatatactgacttttttctgactggctcctgtgtctatctctctcattttttctaacttaggcaaagaatgggaaagtcatttatcaggccccccgaaatcatattgttgatcctctaaatgaccttatcaagtacgtacaatctttatttgacagatgaagacactgatgaacagaaaggttaaagaatttactcaaggtcagtcatccaacaaatgagtttagaacccaaacttttggaccccaagttaaagctctttctccgactgcactataaagtaggggctcaataaacgtgtgttgaaatgaatcaaaacggtgagagaatattgccaggcagcacaaagcttggatgaaatttttcaaaatttttgctggtgattttaagcttcagatgaagtctttgacatttacgattctcttaataaacactttatagaactccaaatccacgtttctgccttgaaggatcaccatcagttggaatatatttttacgctatcctctgccatctttgaaggaggaacagattagggaaaaaatgctttatttaccagtgtaattagaatgaaaatataatgtttaactttcatggagacagactgaaatatgaatagtcatgtagttttttgaaattaaatttctattctaggaggccaacactctactctctctggctttcaaacttccacattaagacttgggaagtaaaaatgctttgggaatgaaactggatgaatggacatgtttgtgccagtattctggggggactctttttcctctcaaaatcccagtagatcactggtcacgtttagaatcttcaaatatgtgctaaaaaaatgttttggggagaaaacaatctcccactctccttgccgagatggaattccaagattgttgggcaagatgaagtaaacgattttcaggagaatcgctgttttccacactgaattgacatgcatttctgcctcacctggttcctacacacaccagccccaactaatgttaggctttgaatcactgaaatgcctgccacaccttaacagcaaagattcagacaagatattgagtaagcaagtttatgaatttttttaaagagaatgatttcttagttagacttgtgttcaacaaaatattctagcatgtggtttcacaaatacaggtgaaccatctggccagcctaggttagctctctgctgtcagtgctgtaaatcttgcattctctttcactcatgtttcacacatggaattaactcttctttgtcctcctgtcctgttatacaatagaagctccaagtcttattcacaactttgagtctagtgtgtggctgtatagaacagagattaagagcatgggttcaagggtacgatggacctggatttgaattcaaccgagcaactttttgtgtgacttagaggtagtcacaccacattactcagttttctcatctgtaaattgataatagttcttacctcatagaactattgtgaaaattaaattcactcacatatgtaaagcatttagcttgccccggcagtaaatattcactactattattgcattaagtgctaaaagagtatttcaagtagaatttttaaaataagagtgagcctaggcacagggaatgcatcaaactggcctcattagggagaattctccagccaactgggatattgcctgactgggttctgggaggtcctcaactgagaccacaaggggcaaatgagcagatcataagcagccctggaggcaccagctcttaaggtgttagccctcatctccccagagcagtgggaactgagttactctgagactctgttcccaagaagaaagtgattcagagcaaaggagacaagttccactgtggaggaagtgtgcccaggtccctcaccggccccggacatgccgtctgggaggctatcagctcagagcccacaccagcttcctctgctattgttcagcactcaccattcttctgataacccggctgtgggaaccactgcccagacgccgggccaacacagaggcacgactacagctgggaagagtctctccttcacatgacgactgagctctgtagggggttgtgatggagaagactgagacggggcaatctaaggcccaaacgtggcccagtgttaagcatattgagaaacccaataccaatctggtgaattgaatagttttgcaaaactaaggaaaattaacagtctccacaaaaaagtgtttatccaagtgttaaagtacttaattgttctcaaaaaaccaaattgtccccattctgaacatttttttgaactttctcaattgcagttagtcttctgggacattgaagaaggcctagaactcaatcaaggaacaaaaatatctaagcattgtatttaaaaaacatgtgttagaggtttattaccttaggagatttttaaatatcatttatctgttaaatttagttgttgcatcagacattttgctcatttttccctttaataattatatctttataccactatctgaatttgtgtctttactctttttcaccttgaaaagggctttttcttttgattatataaataatagatactcagtgtaaaaaaagttcaaccataacaaaaacatgaagaaagttaaaaaatcacctaaaatgccactaccctgatataatcaccatttgctttcagcgactgtatctatgtaatccacatatctagatctatgttcatacagacatatacacacgtgtgactttttatagaagctgtgcattttaaaaattatgaacgcttttttcagtgcagtgttctagatatttctgacacaaggatccaggaaataggttggtatctgatctgtatcttagatttatctacctatatataactagatatacagtataataaaatatctataagtagatagatatttatatggccagctatatacaactacctaaatagagatcagcttatacaatgtgtgtatttttatttgacattctagtatgaattcttaaattatcaaccaatcattatgtgcatatgataaatatgacacatttgttccttcaaaagtttaacatattatttgtgatttgttattttgaaggttaacctggcatatgtcacaaggcatgtggtggctatggcatctgtcagaacctaagatcaggagaccttaacgatgatcaggttctaaacctatgagggtgtttgaaattcaaaatcctgagactgcccacagctaaaagtaaatcagaacccaagacacactcaaaaaaatgtcaactctgaaaggaacttggtgaccacctgctccaaatcactcattttagagatgatgacagtggaatccagtgaggcggatgatgtgtctagagtcccagagcaatcggtggctgaatgtatactaaaatctgctttcccaaatcatcatgccacctctttccatcagattttgtttcctattacatgtcacctaagccagagccattttccctttttccaaatcacaattgatcagagacagctggcatctgtctaattcggacattttcagaaattgagttaaacgggccaggtgcggtggctcatgcctgtaatcccagcactttggaaggccgaggtgggcagagcacaaggtcaggagattgagaccatcctggctaacacggtgaaaccccgtctctactaaaaaaaaaaaaatacaaaaaattagctgggcatggtggcgggctcctgtagtcccagctacttgggaggctgaggcaggagaatggtgtgaacccaggaagcagagcttttagtgagccaagattgcaccattgccctccagcctgggtgacagaacgacactctgtcgcaaaaaaaaaaaaaaagaaaaaagaaaaaagaaattgagtcaaacatagaaatagggaaagcagagtccctgagaattcagactgcattatatctaggaagatagagcagaaggaatagtaataataattattattatagcaagtgcgtttagcacttactacatttcaaacagtattctactactttatgtatatatgctactttacacgtatatataaatttatgtaagtgatatgtatgtatatgtcatttgaccctcacagcagctcaatgaaataactaccattattatcccctctttccaggggaggaaactgaggcacacagaagttacgtgacttcccaggattatataactagtgagtaacagagccagcattatagagtcagcactccagccccagagtccagcctctggaccaatataccacatactgtctcacagaaggaggaactcggacaaattatagtaatgctgctgaaacctcagaagcaacatcaacatcattgagataattaaccgaaccttgtctttgtcacctcacacaccctggtgggagtgccacatagaagtcaggcaattctagggcaattcctggaagctttctgtgtttaccttgcttagttctgcaactcctggctaaagtttccataactggtttttgtcctttgttctttgtttaacattttattataaaaaatcccaaacatatgaaaaagtagtcagaataataaaatactccccacgtacccagctatctatctttaacagttatcaacaaatgttagcccatgtttttttaaaattcacttattcaatttcttcagccttctaaaatatggtttaatatattgtgtaatatacgtaatgtattaacatcacacattttataatttttaggtaagtaaacgtacatatattagagggcacgctcaaacatatgacactttaaaaagcatggctattcgtgggttttgggtgtagccaacgtgtcactacagaaatacagtcagaatgcctgggttcaggcccaggctccactgcttactagctcagtgacctgcaggagtcacttcacttcccagagacttgctcgtctcatctgtgcagtggggatagtaatgctacccactcagggttgttgagtggatcaaatgagatcagggatgtgagactttacaaacagcaaagagacacataaaggtgagcaagaaatcagactaacacaggtggggtggctacggcactggtgttgaaagctgaaatccaaagtcaggaaggccaatcagaggatcacaccaagagtgacaggagaggcaccaggtggagaaccaattgctaactgaagtaacctaggtaggcttttgtgtcctctttgtccctcctgggcacttgaggtggctgcagtcacagctgggctcaggaccccatcagactgagaactgaaggttgagccttattttatcttcttagcctcccctactttttgttttcttttctctttttttctttcttgcagcttatttggatgtcttctctggctgacattacccagaaatcttaggtgaggaattccctcctccagccctggcctactagctgggccatccccaggtcctcttgccagccaaagggaattgagagataggccttctgttctagacactgtgggttctagtgtttaaatcatatttataatgtttgccaactatcctctgagcactgtgccttattagactagtcactccctggctaaggacatggcaaaggtatgactgccacctatagtaagtggaatcaagatggcaccagggctggtttctgtggccagtgggaagaacactagcacattgccctcccttggtgcccacactgccacccagatgacacccagccctgccactgctgcccatgccctcccccagcttcctcaggaggatcagtactgcctgatctctacccccagagtacaagagtccccagccaagcccaccattaacttggggttgctgatctctgttttaaggggtccttgtccctcatggaggagacaggattagacaaacgcagtctctctgaataatcacaagtaagaggaacaaataaatacagacaggccagctgccacagcacatggaaactaagagtaactgaacttgtacacattttataaaccacttggagaatatttttaaattgggatatttctgccccatagtcaccctcgggactttgctcatcaacatgcctgacgcctgagaatggcaactttccaagtagacttatgcattggggtcacaaaggccacatactctgtatgtttcccctgtgatcaaggcctgcagaaactaaaacggctgcaacaagaccccagggtgctgccctgttatatgggctcagggctttaggtggcccattcttgccatattggggtatgtgatttctctgcaacctcaaattgggatgagcgtatatccttcaagtatgaggatgatagccagggctatttgattcatgtccctgtaattgcaggtattattcttatctgcatgtgtactcatttgatgcatatttatatctcagttcctgagaaattatcaggctcagtgcagacatgacagatggaaaaaacagtctttaggacttaaaggattagaagctgctcatagcatgtgtcacagtttaaaactgtataattttaaagtgccattttctttattctcaccagaaaatagtaattatacttgagaagcaatgctcgacagtacatttattgagcaactatggcgttagagagtgtttagcagggttaacaagacacagtccagccttcgaggagttcatagtctagtggtataaacaggtgaacctgtcatttcaatacagaaaggaaaaaaatacttaaaatactattataaagtgtcgtgagcaccaggatagagtgaccaagagtgtgtgaagcaggatttggccatgggggaagactttgcaaagcaactgatgattaagggcagacacggtggggcaggagggggagtgggcatgaggacactcccggcaacaggaacatcttgggcaaatgcatcctggtgatctggcatctcaagtagctgggtcgccgattcagtataggggtgacaagaaatgaagtgaggggtgctggcagagaccggattgacaaggaacgatctgcagtgatggggccaagggctagtatgtggtactttactgcttcccatctctagcaactacctcccaaaccaaataaatggtgcatgcttgccctgccaacgtggcctcatggtatttctccttggttccctcatccttcctatcagattgccacccttaaacctcttcaacatagaaattctggaattccctctgcttctatgcctcactggggagttttctctagtatgtgatggtagccacaacattttcagcaaaggagggatatgataataaccaataaatctatccccaacaaaccacttgtggaagattttggaaatctggaacttcagggcagctattggttcccaggtaccttaatgaaagttttaaaaaaaatgtgcccctccttcaagatgctttattcctggatgtcagaaaactcataatatactactactttaattcaaagacacttttctgccacctaccagaaaatcatcctaaatatacaaatctggcatatctaaaatgtgaatagaacccccttacatgtggcattctgtgcagtgtacaacctgcacaaccatacacaacaattctacttcagagaaaagcttctctgctttcctaaaaatgaggctctgggagctggctgagatgcagtggggtggaggcctggagaaagggaccctgccaactggtcctataaaaacaaaatgaacgcaaactaccctttgttctctccgacatcaccaggtactgagtagagctgaggctgggacctggtaacaagtcttccctaggggcttctactccctgtctgccctcatctccgccccctacccaggctgcctatgacctctggaagacaacttcttctcctgtggtttttgctcaaatgtcaccatcttagggaggcattcttgaccaccttgcttaaaatttcaaaccccagcaacccacctcccaacttcccctgctttatacactttttgacacaccctatatttagtttgtttattattacctgtctgtctccactagaatgtaagctccatgaaggtaagggtttgtttcaattcgctgctggacctgcagccctaagaacagtgcctggcacatatgagacactcaaatattagctgaatgaattaatcatcttccttttggccacttccttccctgtttctgaggtccaccctcttagttctgttgattatggaagttctgttcttctgactcacacagtgtgactttcccaagatcctgaaccatcctgtgcctccgtaagagttttgttctctggagtaaggtgttgggccttattaaaatgtttctggaaggagacagtgcattaatttaaggtccattatcaatttgtgtgaattgattgatgagattccttctcatcatcatatgacttcataatagctatttagcgagtaggaattataattccctatttatagataaggaaatgttcagaaacattaaggaacatgcccaaagtcccatgaatggaaagtactgaagttgagactcaaatgcagaaccatctaagcccaaggcctagagtcaggtggctgtgttgccattctcaacagtggtgcggccaagtgaatatttactgtggttggctcacagcagaaatttatagtcaacattaaccaagtggactccgtttccctcttgctattagacacaattacagtgaaaaatccttttcttcaaggcagatggtttcctacctgggaaactgcaagcagggaaaccaaaacagagtctgccactgtttaacttggacataagaaaaagatgggacagaataaatttcagccattgagatactcctttgagtagatttgtttttctctcttccatgaagtgacaaagtaaacagttgtactatgaattgtacctgattccctaatacttaaccatttgttaaatgttttaaaaaattagagacaggtaggttcagaatagggcacactagccttgaagaaatggtcctgagtggggcactgtggatggctgtgtaagggatagcgccaggcgcctgagccaagttcatttattcatctaacaacggtagaggacctactatgttctagtttaaccagagcatacatatacaagaaaatgcgttgttaaaaaccaagttatgttcaaactgaactacagaatcaggactgaaatagttgcagggtccacggggccagatccaaaccctagaaagttaagcaacatggaaagaatgtattttatccttgctagaggatgagaactgtatatggtttactgtgtggtaaatggcaaacacatacagatgcaaacatctcacagtagtcccctcatggtgactcacagcacctccttagtaagaaactgatgacaacttttaactagcagtgcgccaatgaccatctttggtttggtgcatccagattttttttcccttttgcttccccagattctgctgatccttttctatgtcctacactatctttgtctcaagcactacccaggggagaggtcacttccttgtgtcatggattcattactattttcagcaaagtccggcatcttcacctactgtttggtctgacagcaccataacctcaccacgaataaggttttcatctcttccaatacatgtggtgaaccatttgccagcatcccttaatcatcttggtgtctcttcgtcagctgcctgccttctgcccacgtgttctgcgtcatcctacctgtaatgtggcagtggggacaaggattgtagggttgttccttttggcaaaaagagtaaccggtaggtttattggtgctgaaaatggatcccataaatgaaacataaactctctgtgatcaccatccccctttggctgaggccacatgaggttttatttgttttaccatttcatgcccaatactgtgtggcccaagcaggctgtgcactgagccctggaaatgcaaagacaaataagactcatcccagccaggcacagtggctcacgtctgtaatcccagcactttgggaggttgaggcgggtggatcatgggaggcctaggtcgggagttcgagaccagcctgacaaacatggagaaaccctgtctctactaaaaatacaaaattagctgggcgtggtggcgcatgcctgtaatcccagctactcgggaggctgaggcaggagaatcgctcgaaaccgggaggcagagattgcagtgagccgggatggcaccattgcactccagcctaggcaacaagagcaaaactccatctcaaaaaaacaaaaacaaaaacaaaaagacaaataagactcatccctaccctcaaggagcccagcatttagttggggagacacagagtgaatgggtgacaattgaacatgatgagggctatcacagagccaggaagagaggattcattgcttgaaggagtttaaggaaaggcctgaacaagggataacaatgaaaaagcttagaggccagttgcggtggctcacacctgtaatcccagcactttgggaggccgagatgggcggatcaccagaggttgggagttcaagaccagcctgaccaacattgagaaacccccatctctactaaaaatacaaaattagccgggagtcatggtacatgcctataatcccagctactcgggaggctgaggcaggagaatcacttgaacctgggacgcagaggttgcggtgagctgaggtcatgccattgcactccagcctgagcaacaagactggaactccatctcaaaaaaaaagaaaagaaaaactttgaaatggaagggcttttaagactagcttctctcaacagcacagttctgcctaagacatccaagccggttgctgttttagcaaggagttttagcttctgccctctctacgctccctgtgctctcagcattcagaggcaacacaaactcttctagggctccattccctaatatccctgacatatatatgcctttagtgattcttaggtgattggatggcaaagtcaggaatgcagacatgaaaatacattaaatgagtttcccaatgtgggaatatctccatgagatggcgagctggctgagcaagcatcaggacaacgtggttctcaatacacacttggaaagctgacaaaaattacctcgagccacagagtgattctcaaaccaggattaaaagcagcagtgaccatgtatggccagtctccatccaaatctggtttcaacaaatgacacaggtctaaattccagtattcttaagacaaaagagctaagtgaatgggagtaactcttcatttcctctgcttccctgtagataactgggaaattggaattcgtctgggaaactagctctgctccagagctatgttgtctttttgagaaagtcaattcacctatatgagattagctttcatgttatatgttggagactggtgctctctcttacctactttatggtatttaatgagaattcctagacagtaggttaagcaaaagtttatatgaagcatttacaatgagaaattatgaaaatcaatgtttatcagcagtttatctccatcctctatccgtggtgtgaatgctggaaatggaagcagccctctgggttcaggtcccagctctgccgctacctacttgtgaaagcaagttacttaacatcttcgtttctcagttccttcatcattaaggtagcaataacattaccaaatacctagtatttggtattttaggaattcattcatgtattcattttgcaaacatttactgagcacctactaagtgctatgcaatgagaagcagtatacttttcaggttaaaaggatgaactctggaaccagaatacctgggttccagattcaccacttactagctgtgtgactttaggcaagtcatttaacccctccatgcctcagttttctcattcataacacaaaggtaacaatagtacctgcttcgtggagttggtataaaaaaattaaagtttttaacataagcttagaatagggcctggaacacaacactacataaatattagatatttttccaggtactatactcctggttggaacttacattctaagtggggagcaaaaaaaatcataaatagacaaattatttaatatgttagaagctggtaactactagattggggaaatagagcaaaaacaagattgagtgtaccaggggtagactgccgtcttttaaataatggtcatggtaagtctcactgaggagacattggagcaaaaactggagggaggcaaggaagtgagtcaggcctgtatctggaggaagagtgttggagcagacagaccaaccagtacaagagccctaagattggtgtgggcctgacatgtttgagaagtagtaaggaaagcagtgtagccggagtccagcaatggagtaggaggaaaagagaaggaaatgaagtcagaaaggtaacagcaccagatgacatcagtcattgtgaggactttggtttttacactctgagaagtagagagccattgcgggactttgagcagaggagacacatggtctgacttatactttctaaaaagacctatttggctgctatgttgataatagactgtagagagaagagtggaagcagaaagaacagataggaagctgttgcaataatccagggaagcaatagcaaacgtggtagcggtggggtggtgagaagtggtcagattccagacatgttttgaaggcagtgcaaacagaatttgctgaaggaccagatatggagtataagggaaagaaggcggggagaaaaagatgactccacagaaaaatacagttgccatcaattaaaatggggaactctgagggtggatcagagggatgagctgagatatttattagatgtggatatgttaagtagactgctggatatgtaagttcaggagaaaggttttaaagtcatgacagtaggctaggctcagtgacccacgtctgtaatcccaacactttgggaggccgaggctggcagatcacctgaagtcaggagttcaagaccagcctgaccaacatggcaaaaccccgtctctactaaaaaaaaaaaaaaaaaaaaaataggtgggtgtggtggcgggtgcccataatcccagctacttggtaggctgaggcaggagaatcacttgaacccgggaggcaggggttgcagtgagccaagatcgcaccactgcactccagcctgggcaacagagtgagactctgcctcaaaataaataaataaataaataaataaataaaaaatcatgacagtgaatgaggtcaccaaagatgcaaatataaatggaaaagaggggaaaggaccaagccctagttcacactaatattaagagatgaggaggaagcagaggaactctcacaggagactaaaaggagggaatcccaaagaggccagaccagcgtagaaagtcgagtgtagctctataggtcattttaagtaagaagacaactgagaactaaccatgtgatctagcgatgtggaaaccttggggattaactgatgtaacacatgaggcttggtgaaaggtgtgctccggaatagtgattaccattaccctcatcaataggctttattaaacacccaattgtatcagcatccctgctcccatctgcctgacaccgagggataagaagcctgggttttcatgagtgcagctagatttatttagcactggacagagaggaaaatcaagctggagtctctcagggaaagtggggaagactgaacccaaagaaccggaaggaggaatctgagtaaagtcaagttaagggtcaggggagactgtgtcagatcaaggacaaattgggtatgagctaagaaggccgtgggtgatctcagcaaatacctagtttggcctctgtggtctttctggatgggtggggacaaggttcctacaggactgggtagttttaaaggtccagaggcaggcagatagtgtagacacagtcctctccagttctccctctcttaagactaaaaaaaaaaaaaaaattaaatgtatagagtcccattatatggctcattatacatgacttgtcattggccaagtcatatgtgtgccggaaaataacaattactaacccaaaggcaccctgcaccatgaagctcgtcctggtctcttttctgatactgagtactaagttatgaaggactcatagcctcaggaatatatatcaatggtcagcctgcacggtggaatgttggcactggaagctgttccctaccctctaaatcctgctcacagtccccacctcacctccaaaatcttttcccacatcttggctttcatctgccttgattttgctaagacttggccttctctttgtccaaacaattacaattatagtacctttcttacaaggtggttataaggatcaagtgacataatgcatgtgtatatggtgcctagcacagtgctgggcaaagaaaagtgtcagaaaatgcttgttggtgttgtgagttaatcccttgttaggatgcagatgtgcctgaaaagagtaatgctttaaacctgcccccgagggtaaaggaagttcattagaaaaggttttgataagggtcagggtgggagcacacatgaagaaatggggaaaaggatataagggggcttcaaaaacaaactagtcgtgtggcctgccccagcatgtgggcctgaccaaaacaatcctatatataggcactctcttaccttccttagcattgcaacctattgcgttaataccaggccctcaggcatcacagcgcctctgtctctctagaccatctccagccactaccttcacccgacttacaattcagctaaactcaactactgtgtctttgcttgtgctgtttctttcctgcctcttcctcaagtggctcccactttgcattcaagactcagctcttgtgtctggaaaccttttaaatcatttctcccaagctgagcattgagccctcctctgtgtgactacaagcctatacttacttattgtatacagcttagcacttttaatattagttggtacaaaattaattgtggttttggaccgtgaattttaaacattgtaactaggctcaaacacttctttattaattaaaataagaaccattacaatcaacatatttttgccaatgagaagcaaatttgtttattcctgtagcataaaaaatctgtgctttgggattcaacaactcttggaaagtactttctgcatcctgctgattgtggaagcatttcccctgcaaaaagttgtcaaaatgcttgaagaagtggtagtcagttggcaagaggtcaggtgaatatggtggatgaggcaatacttcaaagcccaattcgtttatcttttgaagcactggttgtgcaacctgcagtcgggggttgtcatggagaggaatttggccctttctgttaactgatgccagctgcaggctttgcagttttcagtgcatttcatcgatttcctgagaatagttctcagatgtaatggtttctgggattcagaaagctgtagtgggtcagactggcagaccaccaaacagtgaccacgactttttttggtgcaagtttggctttgggaggtgctttggaccttcttccccatccaaccactgagttgtcatcaccgattgtcatataaaatccacttttcgaagtatgtcacaatctgatcgagaaatggttcgttgttgttgcatagaataaaatgatggttcacaatgatgatttttaaaattttcactgaactcatgagacacccacttttccagctttttcacctttccaatttgcttcaaaggctgaacgaccatagaatggtcaacatggagttcttcagcaacttcttgtgtaattgtaagaggatcggctttgacgattgctctcaattggtcgttgtcaacttccaatgccaagacactatgcacctcatcttcaaggctctcatctcctttgcaaaatttcttgaaccaacactgcactgcatgttcattagcagttcctagccaaatgtgttgttgatgttgtgagttgtctgcactgctttacgacctattttgaactcaaataagaaagtcacttgaatttgctttttgtctaacatcatttccacagtctaaaataaacataaaataaaaagcaagtaataagtcattagcaaaaaaaaaaaaagcaagaagtgcacgttaaaatgatgtataacataaccacattagttaagaatgtgttccaatatcaaatggccaatttcaacaatgcaaaaaccacagttaagtttgcaccaagctaataacatgccatctcccactaggttttatggtcttccagcaatgcatctgacacctctcactctgtacagtgtacagtccctgtacagtggctggcacacagtaggtgcttactaagtgtggcagtatacacatgtacagagtcaggcaaaaattggtgtattttggaatgaataatgcagaggaaatagccaagcaattttcatgtatgtttagaaataatcagataagagagaccaaactttctcttttatcattccagaaacatttcacagaaaaggtcacttttaatagctatttggaagaaaatgagagatgaaaagagcactttcagcagtggaatggaatggagcagagtagggtttgaaggagggagtagagaggaatggagtctcctgggcttgtggggccacagcaggaaagagaagtccaattacacacagggtgtttgaagttagcataaggacttcgttttctattcctcttctgttggatcacatcaaaaaaaagaaagtggtacatggcataacagttggggagtcagatagactccccaacatttgaattttgtctgttttcatttttttataatcctatgcgagttgcttgactttggtggacctcagcttcctcatccacgaaaatggaatgatccactgcacaggtaatgaggtaacatttgaaagttcttagcacagaatctgactggattagtcagattttgctgcagcaacatataactcccaaatctgagtggcttacaaacacaaacatttatttcttgagggctgtgaattggctttggctctggtggtctccacagatctccatttatcttttcattcagtgacccatagcaacgggatggccatcgtctaagataacctgttttcactgtggagcacaggctctgaaggggacacagccaaaccacaccagctcattagcatcttcagctctgccatggcatagggcatgtctgctcatactccacttgacaaggtaagtcccatggcccagcccaaggccaatagggatgtcttctccacctccagaggagtgcagccatcggggagtgcacacatcattgtcaacaagtaaagctgcctaccacatgtggcgtttcattggctactgctcctgagtcagtaaatatgttcatagatatctagagatgcaagcggcctaggagaaggacgggacagttatgtccaaggaggtaaaaagaaatgtacacttgtgtcaaaacctattcccgccaccacaaacctcttctattgctccaaattcccagctttgggaaaaaatgggtgaaaaagaattaatttttttataggggttcatggtaacagttcctttatctcttactttcttcttcctgctcacttctcaccaaccaatctggcctccttggcattttttgaaacattaaacatgctgccagctcagggcctttgcacatactcttccatctgcttgaataagctgccccaacatctgcatgaccccatctcttacttcatcaggtctctgctcaaatgtcaccttgtccaaaaggcctcctctgaccaatctatataaaataaccaacccctgccccaaccatcccttattacccttaacctgatttactgttctccataggacttatagtctgggatattatatatgtacttatttttgttgttatttattatctatctccatcatttagaatataagctctgcgagagcaaggaattactcactgctgtatcaccagcacctagaatggtgaatgatacataacaggtagtcattaaatatttgtggaattaattaattgagcaaatatgcaccatgactttacagaaatgaatctcattttaatcttcacaggaactatacaaatatacacgcatgtggtattgccaagccccattgaatgggtatgaatacttaagtgaaagatttaaaataactcacccaagatcaaacagcacagggctgcccacactgccaacactataaggaggggtaggcagggcaaaggctctccctccaggttgtagctgagacacagcattgctgcttctccttcccaagacggaggaagtatggaagatcccttgtaccctgcaggaccagcagagccctgtgccctggccaccctgcctcccaggaaggtgccaggcagagaacagaatatcctccacctggaggtagggaggttaggactggggagagggagtaaaggagacactggtctgctttttgtgaccatgaccagcagaaagagggctagcccggagcacatcaatagcaccttgttgacttttaacgcttcctcaccacctcttcttctgtgtgcgccatctctgataacatgccacagccagcgtaatctcttcagggtgtctctcagccctcctgccctgctacagcctttcctctgcccagctccaagcatgccgtctgcagacaaaggccttgaagaggctgcatgtgtccttgaccctcactgacagcacttgcttctggactcagagggagccccagggaatgccccggccaccttccgcctgtttcaaggctttaccatccaagatcactggcagtaagaattcgttcatcccttttactgtcccatcattcccactgccccctaaccctgcagtgcctttcccttgtcagtagccaccaacagaaaattacagaaacaaaagatcatcactcttcaattatttattcaatgcctgtgtataaaacaccaccataatactgtcctacgtgtctgcagagctgacagtgtccagcccccactagacaacctcatgcccttcctcagatgtcactctacaggaagctgctcacccagcccatacacagagactagcgagatgacccagaggtaaactccagatcagtgtgtctctcatgctgatttttaacttcagatgaacttgcaggaccaagggagcctgcaggaggaatgatctccaggaaccaccaccccttccaggagccaccgtttaagggcttgagaatggccctctcttcccctgccaactgttctttgatcctctagaagagtgttttttaaacacagcaaatcacagctcattagtgagacatgaaatcaatttagtgagctgaaatcaccatattttatcttaaaagagaaaagaaaatagtttgcgttgcacaaagtaaaggtgagtattgttttataaaacttctctttcggttgtgtgtgtgtgtgtgtgtgtgtgtgtgtattctgggtggagtattgagtgtattttttgctgttatgacacagaatttacccatcaaagaaaagcacctattataagctgtggcagagggtcttccaaaggcggttgtcctacccactcaacaaggacaagcttggggttcatgaatcatgggatgtgaactgtgaggacctgacagtcaccttagctcgtgggtatcagggcatccagaggagtttgatttgagagtgggactgatcagaggattcaacagtcctaaaagaaaaggattcttgctgctaacagtaaggacaaaactgagagactaaaggtagcagaacaaacaaagggtctggtgcatggattgctccaaagaggaaggttaaagtaggctgtcagtatttaatgttaatacaaagcacctagctaggtgctgtggagttcaaaggaacaagatagatcctggccttaatgagcccacatcacagtaaggttgaaaaccaagcagatctgaaccagtaatgggcccacatgtgcaaaacagcatgttaatcaagagtagacctcatgggtatcaactataagagtagtaagcagccagaagcagagagagtgtgagcaaactcacaggggaacttgagcaaggcgctaagggatgagtcagaatagtggggtgggaaaggcatttaagatccaatatccagagaaattgagtcaaggtgggagctccgagccaatgtgatgtgttcttgagcctacaccaatattagcctagctggagcagagggattctgtctggagacttgctttgtagggtgaggcaaggttatgaagggtcaaggaaatggatgtgatattataaataaaataaaaatctaacataacccaaatgtcagtttcaggcaccctgccacttgagattcagataagattggctcgaatctccattccacatcctgtggaaagtttaatgccctccccaagatgtctgcattctctcagagcagttacttttttgtggcctcctctggttctggaattagttctgttgttagtgatctcaccttccagtgcgtgtagccctcttacccagtcccttgagtgacagtcccttgaaacccagtccctttccttgatttacttatacacacatacatagacacacacacactacaattttacaaggcctttgctgacattttgagaaaaatgaagaagggaggatttacccagaagcaatggaaacaaatcaaaatttaatattaaaaagtctgtgttcttaacagattatttcttccctaacaggaattctgatgccagctactaagataatagttgagtttttatttttaattattattctgcttcaccaagaaatgttacagaagaagagtggcagctataaatgacagagtaggaggtggaggactaagtgcagaggaggaatgaaagaaaggaaacaaaaaagagggtgtggagatgattttgaggtttaaaacattgtcaaaggaatgaagaaaaacagaagttaaggaaattcaaccaagtcacattgcactgacttgtatttactaaactgatgttttgaaattcaggtctgaggctggtaggaggaaggagtttggagaaaggagccatgtagaatgacacatggaggttagacctccagccagagaggaacatgaagcatctgaattctagcctgaatatgctcctaacttgcagtataatcttatttaactcacttccttttctggaacactcagtttcttatccgtacagcaagaaagtcagattagtgaccctttgccataaattccatcatcatctgtttatttttattgtctttctaaacttattattaatagctgaaggagccacaggaaagagttcaataattgtgagtggagggcaagagggatatcaaaacttctgaaaatgagtgggattggagatgttagactagttgactaggacattagctaaaatgttgtacagttattctaatagagttgtattttaatagagaaagaagatctttagcagaaacacatactaactgttctgagactcagctctccaagaaggcctggtaggtgggcccacaccaacatgaacattcctctctgttattctggtgtctcctatcccaactttggacatagtatctagaaaagaaaaatacgcccactaaattctgtcttgataaacctaccttccaaagaagaagtgtttctcaaagtgtgcgcagttggtcctaaagatgctctgaaaataaatgaaaaacaaaggggaacccttgtgggaaaccagcatatgcaccccccaacatgtgactgtaggagaccagaatatgttaccccaaaatatgactatggggaacataatatgcaccccaaagtatgactatggcagaaaagaatatctacccccaaatatgcctttttggcataaggattattttgagctgattattttgagaaacttcagacacaggagaaattctgaaaacagagtagaagttacccttttgtaagggaaatttatacccataagcctccatttgtaagggcatctttctctcagtataaggaagagaaggctgactaaataacaagagacttatcaatggagaagacactgactttaatctgcataaccaatcttacccttgtttcccatgcttctcctgggcatctcctcataaccagcctttcccacacctttctttctttgtcttaacagataatggtatttaagtctgttctgagattaactcatttctctgggtatctcccagagatatacatgaggtatacatgttactaaacttctgtttctttttcttttattattctgtctttttttttttttacaggagtctttcttatctaaaaactatgaaggatagagagaaaaacatttcccccccacaacatgtacttgctttgagtcttgctgaacttcccacacattctgtgctcatgggacattgtagatgttatatgtaaatagggtaacagaagggcagagacacatattctctctgttcgtggacctgctccgttttcccatcagattccacttatcaaacaaaagttcaaagataagattaggaataatttcaagatggtgagagcagtgtactaagccaagtaaaggggtcttctgagcacagggtcctatgtgactgcacatgtctctgcccatggagccagccctggaaaagggttcatcaatcacataaatgtctctccctctgctggccattattgtgctgtatttgggagatatggcagccatcttccgaccacgaggggaactagcctgaggacacatctgacataagggaagaaagaaagaatggtgtctcagttcattttgtgctgctgtaacagaatatcaatttgtgggtaatttataaggaacagaaacttctttctcacaattctgaggctgagaagtccaagagcaagagggtagcatcaggcatggaccttcttgcagagttatcccatggcagaaggcagaagggcaagagagggtgagagagggcaaaagagggtgagagagggcaagagagggctaaaccacttttattataacaacgcacactctccataacgaacccactcccacaataatgacataaatccgtgtgtaagggcagagccctcacgacctaatcaccttttaaaagtctcacctctcaaaagtcccacctcccaacactattgcattggggattaagtttctaacacatgaactttgggggacacatttgaaccatagcattcttcccctaacccccaaaattcatgtccttctcacatgcaaaatacatttatttcatcccaatatccccaaagtcttaactcattccagcatcacctcaaaagtctgaagtccagagtttcatctaaactgattatcagtgagactgaaggcagaattcatcccaaagcaaattcttccagctgtgagcctgtgaaattaaacatattgtctacttccgatatacaatggtgggacaagcatataataaacattcccattccaaaagggagaaataggcaagaagaaaggagtaactggtcctaactaactataaaacccaacagggaaagcaacagtatgtcttaaagctggagaataatctcctttgactccaaatcctgaatcctgggcacacctgggtggaggttaagcccccatggcccaggcagccctacccccacaactttgctgggctcagccaagcttcatctctctcaagctggagtctggtatctgcggcaatcccagcctagattacactaaagcacccaggcagtgatattctgttatggcagcacaaaatgaactgagacaccaattttggagtcttggtggtggtcttgttccctcagctccagtagatatttccatagtgggagttttctgcggtggcctcattcccatggcttcactagtcattgcctaggtagggattctctgtggcagcttcactcctgcagcaagtttctgtctgagcccccaggctgtccacaacaccctttgaaatctcagtggaggccgccatggccccacagctcatgcactctttgtgtctgcagagttagcaccacatggacaacaccaaggcttacagcttgcactctctggagctggggcacgaaccacatctgggcctacattcaccaaggctagagtgaccaaggagcactgtgccagaatgtggggagcagaatcccaaggcaaccctgagcagagagctcatggagggcactcaaggctcatccccccaaatcattctgccctcttagagttttgggcctgtgatggaagaggcagccttgaagatctctgaaatacctttggggtcattctcccattgtctcaatgaatagcatctggattccttccatctgtaatcatctccttattaaatagttgcttgtctgcatccttggtgtcctctcataaacatgcttctttgccaggcacggtggctcacgcctgtaatcccagcactttgggaggccgagccgggcggatcacaaggtcaggagatcgagaccatcctggctaacacagtgaaaccccatctgtactaaaaatacaaaaaattagccaggtgtggtggtgggcgcctgtagtcccagctactcaggaggctgagccaggagaatggtgtgaacccaggaggcagaggttgcagttagttgagatcgtgccactgcactccagcctgggtgacagagtgagactctgtctcaaaaaaaaaaaaaaaaaaaaaaaaaaaggcttctttattctttacatggacagaaaacatttttctaaatttttatattctgcttcctttctgatcataaattcaatctttaaactatttgtctcatttttcattttactgcaaggggccaaaagaagctatgcagcacctttggtgctttggtgcttagagatttcttctgtaagatatcctagtttattgctcttaaattctgccttccataaagcccttgggcatggataaattcagccaaattgtttgtcattctgtaacaaggatgacctctactccagtttccaataacttgtctctcatttctgtctgagacctcatcaaaatggcctttactgtccatatttctaccaacattcagatcatgaccacttaagtaatccctaagaagacaggctctccctacagctcttgtcttcttcatagctcccaccagaatcacccttaacgctcaagttatgacaatatcggctttttctagcctgttcctccaaattcttccagcctctacccattactcagttccaaagtcactttgacatttttaggtatttgttatagcaacagccccactgcttggtaccaattttgtgtcttatttcattttgtgctgctataacagaatcctacagtctgagtaatttataatgaacagaaatttatttctcacagttctgaagactgagaagtctgagatcaaggggccgcgtctggcaaggcaagagagaacaagagagggctgaacttgcttttataacaacccactctgtcaataacaaacctactcctacaataatgacaaaaatccattcatgagggcagaggcctcttgacctagtcacctcttaaaggttccacctctaaacattattgcattggggattaagtttccaacacatgaactttggggataccttgaaatcatagcagaagtgtctttggagaggttattgagtctctaaattaatcagttcccctagccactttgagttgagttttctcttatttgtagctgaaagcatccaaatttggccccaacccagaaatctatatttttaactagctccctgggtgactctgatgcaggtagtctagaaaccatattttgagaaactcagctctaaaatgatggcaaacatctcagctgtatcagaaaaaccatgtttccacgagatggatcacctcgattgattcaagtgggtgcctcaaatgcacagttcttacttgctttgaccatcaatactgcctttgtacaaagttccacgtaccctctacacttaagaatttcttttttaaaagttatctgtgattgcttaacatcctgggaactaaatagctgaaaatcttggttttatatctattttcttcatgttatccctccagggtgatatgggaagatttattgacttccttagtacctcatggagaaactgcatggtgtaaaatgtttttagagtctcaggattctccaggggctcacccaatcactcaatacccatgcattgatctaaataaagaatagcggcggcggctgctattcttgcaaagtagggtcacagtgcctaacttcccctcctgagaaaacaggggcccagttctgacctgcactgtcctcatagagcttagatcgggcaagggaacagaagcagctgcagcagggagtatggagtaactggggaagagaaatcattcagggctaaaatagcgcctgaaactcaaagacagtccaattcaagtgcccaattcacagtgatccgaaaagaaagaccaggccaaggaaaagaacaggtcgtaacctgggtcagtaagacagagagagagagagaaagagagaaagacaaagagagagaactggaagttgagagggatacaaccagtttccctttaggggtgcctgtggctttccatggaagagaaagaactattgacgacattaagttggtttgttgtggagaaaaacaccacaaacttcttagtacagattgagtaatcctaatccaaaactgaaattcgaaatgttccaaaatctaaaactttttgattgtcaacatggtgcttcaagaaaatgctcattggagcatttcagacttttaattttcagattagggatgctcaactggtaagtataatgcaaacattccaaaattcaaagagacctgaaatccaaagcacttttggtcacaagcacttcgaataagggatacttaacctgtatatgcatttgtctctcagcaaattggtaacaagtagaggctcaaatctccgacacagtatattatagatggcacttttgctgcaaggggcagaaagaagggataaaaaattattttaaagctgtacatagtcctccataatgcactgtcttacattattttcttactgcatcatggagaagaatcgtctgcatctctcaaggggattatagctccctgaaggcaaggaccatgttttatacttgtatcaccactttatggtgaatttacatctccacaagttgaactgaattgatttgagctataccatttcccaaaggagtcatttgatttagaaagcaataaatgaaacaagggccgtccctctgtagaggaaagccaacaggcacttccatagacattgtatcaggaagtgggagaactgatttcatcccacccaaatgccatattttaggccattatccttttgtaatgaaaatgggtgggaatatattaatatttctcctcttcctcctctatcttcttagtcttgtctcaaaaagtctctcttgaaactcctccttccataaggcctgcatttccgccactggagacttgttcctttgaattaagtatagccctcttgagcccaaagttttaaaatgtaaatacctctgggaaaagaaacacattacatctctattacttttatataaatgcatttaacccaggctcttctcctcgtagaaaggactaggctcctccgggggctaagaatgatgaaaagggaggaaagcaatgatgcccagagaagaacagatgtatggggcagggaaaaatggtgctcaggtaaaagtcagcctctgtcccaatctcactgaggtctggccctgaataaaaccaataataataatcacagtagcttttatagctcattatgtgagactcatttcttcgtggtaaaactcctttacaaagctcattacaaataactccttacacagggctattatccctttgtaattaaaacaatatattgcatcctccacttgggattcctgtgaaacagcatggataatacacaatggcactctgaaagcttttatttagttcctcttgagtcaaagcagaagcttccaggaaagatttatcagctaattccagagagttatctcaaataactcacatgcaagatatgggaaccgtgggggagattcaaagctccctttagggtgtgaagaaggtgcaaatgtaagatcatctccaaagctctcatgaagccaatgacgtatcacctgtggatttactggggaaagagtgagaattgtggcgtgagcagagaatgagggcttatctcttctaagcaagctaatctttccctgacatctttctttttgcactagaaaaatgtattttttaataggtatgctttgtataaaagaaattttgaacttttgaaatccactgtttgttcttttcaaagggtactaatagtgggcctcagtgactttatctataacttggattaataatgcccacctcagagggcagaagtgaggatcaaatgaagttgcatgtgaagcacctggtcagagccaggcacaagggagaggctccatggatatttgttaggtccctttccaacttctctcaacctgactgtaatcccagaacttgctctgggaagccactgtgtcaaaactcctagatcccatttctaacttctactctcccctaaactacattgctgacaaggagctgcctcttctaggtacaacaagaaaggattttgatttcctaactctcccataaccaaattttccaaaaccaaagactggaatgcatggcctcaccatacggatgggtttttttcttttcagatatgttaatttatttatgtgacaagtccttcaaaggcaaaataattaagatacattcagttatgtatgtaaagaactatctttttaaagaatgaaattacatcaaaagaaagaaaactcagcaaaaagtcctggataatttgacattgggactgttggaaacagcatagtcatcacagacaccttcttcattcgctgatcactaagggtttttagagttgttgccaacaatgttaagtcccattcggtcatgggctgacctttctttgccaagtagcctggaacattttagtcctttgttgcatgtgttgccatttcctcagacccacagatcttatgacacacactctgggtgttgctgagctgagatgcctggaaagtggtcagtatgtccaagtgatgtgaatggagggagaatcctccaaaaatagaaacataaacagatgcaaggttgagaaataagtcaaattgccatatcattattttgtttggggtagtttaatgctgtggctcatttttatctcatttcttacatcctttagccaaagcagaaagactggttatccccattcccctctgccctaccttcctaccatctcagagacaggctgcttgagggcaaggactgtgccttccaataaacaattcaactagcagatgttcattgagtgagtcacagttaattacttaataaatctgacattgaagtccagactgtgtgacctgaacaattgtttccctttagttaacaccattcttcatagagctaataaatccactgagaattctctagagcttccccttcttccacaaatggaatggctccagcttgaccaggctaagaagcacagtgacacccatcttagctggcttaattctcaaattctcaattgctggataagtcttatctatagccacggccagcccttgacaaactgtaagtctagcaaaattgcgtgtctcaaacacatgtgtgttttttttttttttcctcctacatctcctccccatcactggcttccctcttcccctacttccattttcatcactgcagggcccaagctcttacctgtctttatcagaattaactcttagggggataagaatggtatggaaaatatacatcagttagcatcagttaaagaggccagtcaattcctgcctctgaatactatattccagcccttcaattaaccatttccctctttttagccctgctccatttctcagatccatcctgagaggctgaaagtatgtttgcacaagcacgagctttggagtctagctatgtgacgttgaacaagtcatatcatcttgcagtaaaatgggaacaataaatacctacctcttggggttattgtgaggagtgagataatatgtataaagagcttagtaccagacctgaaacatagtaagtactcaataaatggttgctgttattattacacttcccaccccaatctggtacttaattttgatcactctctccatatacctgcatgtctttgacgtcaggatcttaactaatctatctttgaccccctgtacagtgccccatgtctagcaaaaggtagatgcttagtaaatgctgagtgaaggaacaggaccaacactgccttagatagagtggggctgactcctgggctcctgaattgttccctgagttgtagctcctcttgaattgggcttctgattaagctttattctagtttcccagttctccagagaggactaaacattttctgcacctgggacactggattcctgtccctgagtcacatttcaggctggggctaaagcccaggaataatcccaggcatcgattctctgccccaggttctacatggtccaactgctgaggaatagcttgaagttcaatactcttcatctccatcagcgcttctcccacctatgtggacaactgccattttctaaaccttacataaaacatgaatagaagttttttgttgttgttttgttttttgacatggagtcttgctctgtcacccaggctggagtgcagtggtacaatctcagctctctgcaacctctgcccaccgggttcaagcgattctcctgcctcagtctccctctaggactacaggtgtgcaccaccatacccggctaatttttatattttttagtagagacaaggtttcactatgttggccaggctggtctcgaactcctgacctcaggtgatccacctgcctcggcctcccagagtgatgggattaccaggcatgagccaccacgcctggcctaaaagtttatttttaaagtactgctttgttgattgatctatgctgtacaatctaagtaaaaacagagtgcttgctatgcaaaagcagcttcaagacaagaatcctaacacccactctgtctttgtctttttgggctgctataacaaaatgccattgattgcatggcttatacacaacaaaaatttatttcttacagttctggaggctgaggtccaacatcaaggcaccagcagagtcagtgtctagtgagagcttctttctgtttccttctaactgtattctcacatggcaggcagtccaaggcaactctctagggcctctttcataagaatattaatgcaattcatgagggctccatcttcatgacctaatcacctcccaaagccccaactcctcataccagcacattggtgattagatttcaacatgagtttagggagtatataaacattcagaccacagcacccgccaatctgattcttgtccctaagtgctaccccagtatggaaattctagagccaccactaaccctgtcccctggtcactgatagatgacttctgctaaacttggaaacttgggctaaacttgggctggggcagctgcccaagcactgccctgctctaaggctggaaagatggaggggatgttcttttttttcatccacccatgggaaaaccaccctagccttggatcttgcttccctagacctgctattgaaccctggtcactctcatcttcccaggccttgtccagtgtataaaggagtgagtgaaaacaactgtgaagggtctcccagcctgattgatgtattcctataccaatggccccttccaggtagtggatttaactcagccagaaatggccttctcaaagccaaaaaagcctcttccaggcagatggaggtctacctcagcgtgacatctgacactccctttcctgcagttcagctctcattgcctgaaacgccctccctgagtcagtcaccctgcatcacttgcctcagcactcagggctctgcacacgtgctgtaggcatttcatctattttaataataaaacaaaaatgacctcagcatagggacaacagcaaccagtcaatggctgcaaaatcattcctacaatttcatattaacattctgtcatcagtgacgggaatgatgaagacattcattaaaaaaaaaaaaaaaaaggacagacttagccctgggaagatggataattatctctgctaattacttctgtgcctttgtttaaccattgcccagcccagaaggccttgcccccacctgcatgcccatcaattaaagtcttactcatccttgaaggcccaactcaaatgccactttctccaagaagcctttcctagtcctccagttagaattaattgtcccctgctcaatgttcctgtgatgtttattgtataatattcccatgtcattatattaaaatgttatctatttattacataatatatattatgcagtattcctatatcattattataaaaatggtaccataaaggtatatggaagatgattagcactctgagcagcctataactcagcctcaataaaaaagaactattttaagattatgaataacttcatatctgccccacaggtcaggctctaaaggtacatagttagaaagaaactaacttctttgacattgtgaatcacaaaatctagctgttctaaaaacaaacctgaaagaaaatgtaggtatgagccataccccacgttccttcatctgctgggataaacacttcactttgtccaaaagatgtcaagtctcagaatgaaacaggccctactaacctaaccagcacatcacaccacataagacacataaaatcccctttccatcattccagctatgctcaaactcacttccacctgaggctactcactaaacttttaagcaactatagcaacaagcatcataaaaatagctatcccatattgagtctctacaagtagtagaccatatgctagattatttaatatctcagttaatcctcatgaaaacaaaagggtcagtttctcagagtcacagctcctaagtagcatattggagattcaaataaagatctagctccaaagcctatgctcttaccattaggtattcctgcttccttagtcaccggaaaagtttcctaaattttgtaatttaggtggaagctgcaaatttcacccatggttgtgagttttcctcttggagaccatcaaaacatatctaattccccttctactttaccagcctgcaaataattaaaaagaggtggtgtgactccaagacctcttatctctgggctagacatccttcagctgttgtccctcttataaaatggcttcagatcacatcatggtctggcccccatctctttttttattattgttatttttccataaattatttttaatttatggaattacaattctataatttataatattccataaattataattccataatttaatttatggaattttaattcttaaaaaataaattatatttatttttccataaattattggggtacaggtggtatttggttacatgagtaagttctttagtggtgatttggtgcacccatcacccaagcagcatacactgcaccttatttgtagtcttatccctcaccctcttcccacgcttcccccaagtccccaaagtccattgtatcattcttatgcctttgcatcctcatagcttagcttctacatatcagtgagaacatatgatgttcggttttccattcctgagttacttctattagaataataatctccgatctcatccaggtcgctgcaaatgctgttaattcattcctttttatggctgagtagtattccatcgtataaatataccatggtttcttcatccactcattcattgatgggcatttgggttgcttccacgattttgcagttgtgaattgtgctgctataaacatgtgtgtgcaaatatctttttcatatcatgacttcttaacctctgggtagatactcagtagtgggattgctggatcaaatggtagttctacttttagttttttaaggaacctccacactgttttccatcacactgttttccatggcggctgtactagtttacattcccaccagcagcgtagaagagttccctgatcaccgcatccatgctaacatctactgttttattatttttttattatggtcattcttgcaggagtaaggtgggatcgcattgtggttttaatttgtatttccctgatcattagtgatgttgagcatttcttcatatgtctgttggccatttgtatatcttcatttgagaattgtctattcatgtccttagcccactttttgatgggattgtttgtttttttttctcgctgatttgtttttgttgtatattctggatattagtcctttgtcagatttatagattatgaagattttctcctactctgtgggttgtccgtttactctgctgactgttccttttgccatgcaaaagctctttagtttaattaggtccccactatttaaatttgtttttgttgcatttgcttttgagttcttggtcatgaaatccttgcttaagccagtgtctagaagggtttttccaatgttatcttctagaatttttatagtttcaggtctttgatttaagtccttaatccaccttgagttgatatttgtatggggtgagagatgaggatccagtttcattctcctacatgtggctagccaattatcccagcaccatttggtgaaaacggtgtcctttccttaactttatgctttaagatcagttggatgtaagtatttgggtttatttctgggttctctattctgttccactggtctatgtgcctatttttataccaccaccacgctgttttggtgactaggtgactatggccttatagtatagtttgaaatcaggtagtgtgatgcctccagatttgttctttttgctttgaccatgagggctcttttttggctccatatgaattttaaatttttttttctaattctgaaaagaatgatggtggtattttatggggattgcattgaatttgtagattgcttttggcagtatggtcattttcacaatattgattctacccatccatgaacaggggatgtgtttccatttgtttgtgtcgtttatgatttctttcaacagtgttttgtagttttccttgtagagggtttttgaccccttggttgggtatattcctaaggtgtttgtttgtttgtttgtttgttttgcagctattgtaaaaggggttgagttctttatttgattctctgctgggtcactgttagtgtatagaagagctactgatttgtgtacattaatcttgtatccagaaactttgctgaattcttttatcagttcaggagctttctggaggagtctttaggattttcaaggtaaactatcatatcatcagaaaacaataaacgtttgacttcctctttacctatttggatgccctttgtttctttttcttgtctgatcgctctggctaggacttccagtactatgttgaagaggagtgatgacagtgggcatccttgtattgttcccattctaagaagaaatgctttcaacttttccccattcagtatgatgttggctgtgggtttgtcatagatggcttttattacattaaggtatgtcccttgttttccaattttgcttagggttttaatcatacagggatgctggattttgtcaaatgctttttctgcatctattgagatgatcatatgattttgttttttaattctgtttatgtggtgtatcacatttattgacttgcatatgttaaaccatccctgcatccctggtataaaacccacttgatcatggtggattatcttttgatatattgttggatttggttagctagtattttgttaagaattttagcatcagtcgggcgtggtggctcatgcctgtaatcccagcactttgggaggctgaggtgggcagatcatgaggtcagcagatcaagaccatcctggttaacacggtgaaaccccgtctctacaaaaaatacaaaaaattagccgggcttggcgagcgcttgtagtcccagctactcaggaggcagaggcaggagatggcgtgaacccgggaggcagagcttgcaatgagccgagaccgcaccactgcactccatccagcctgggcgacagagtgagactccgtttcaaaaaaaaaaaaaaaaaagaattttagcatctatgttcctcagggatatcagtctgtagttttcttttttggttatgtcctttcctggttttggtattagggtgatgctggcttcacaaaatgaattcgggagggttccttctttctctgtcttgtggaatagtgtcaaaaggattggtaccaattcttctttgaatgtctggtataattctgctgtgaatccagctagtcctggactttttttggttggtaattttttaattaccatttcaatcttgctgcttattattggtctgttcagggtatctaattcttcctgatttaagctaggaaggttgcatttttccaggaatttatccatctcttctaggttttctagtttatgtgcataaaggtgttcatagtagccttgaataatcttttgtatttcagttgtaatatctcctgttttgtttctcagtgaggttatttggattttctctcttcttttcttggttagtcttgctaatggtctatcaattttatctatcttttcaaagaactagctttttgtttcatttattttttgtattgtttttgttgttctttcaatttcatgtagttctactctgatcttggttgtttcctttcttctcctgggtttgggtttggtttgttcttgtttctgtagttccttaaagtgtgactttagaatgtcagtttgtgctctttcagtcttttttttttttttactatagaatgccagtttgtgctctttcagtcttattattattatttttttttgaaatggagtctcactctgtcgcccaggctggagtatagtggtgcaatctcagctcactgcaagctccgcctcctgggttcacgccattctcctgcctcagcctcccaagtagctgggactacaggggcccaccaccacacccggctaatttttttgtatttttagtagagacggggtttcactgtgttagccaggatggtcttgatctcctgaccttgtgatccacccacctcggcctcccaaagtgctgggattacaggcatgagacattgtgcctagcctctttcagtctttttgatgtaagcgtttagggctatgaactttcctcttagcactacctttgctgtatcccagaggttttgatagattgtgtcattattgttatttagttcaaagaattttttaatttccatcttgattttgtttttgatccaatgctcattcaggagcagattatttaatttccatgtatttgcatggttttgaaggttccttttggagttgatttccagtcttactccactgtggtctgagagagtgtttgatataatttcaattttcttaaatttattgaggctcattttatggcctatcagattgcctatcttggagaaagtttcatgtgctgttgaatagaatgtgtattctgctgttgttggatgaaatgttctgtatatagctattaagtccatttgttccaaggtatagtttaagtccattgtttctttggtgactttctgtcttgacgacctgtctagtgctgtcagtggagtattgaagtcccccactgttattgtgttgctgtctatctcatctcttaggcctattaacaactgttttataaatttgggagctccagcgttaggtgcatatatgtttaggattgagatattctcctgttggacaaagcattttaccattatataatgtccctctttgtctcttttaactgctgttactttaaagtttgttttgtctaatataagaatagctacccctgctcacttttggtgtccatttgcaagagatgcctttttccacccctttgctttaagtttatgtgagtccttatgtattaggtgagtctcctaaaggcagcagatagttcattggtgagttcttatccattctgcggttctgtatctttcaagtgaagcatttaggccatttacattcaatgttagtattgagatgtgaggcaccattccattcatcatgctatttgttgcctgtgtactttgttttgttttttgtttttactttttaacttgtatttttgtcttataggtcctgtgtggtttatgctttatagagtttctgttttgacgtgtctccaggatttatttgtttcaagatttacagctccttttagcagttctttttttttttcttttgagacggagtctcactcttgcccaggctggagtgcaggagcacgatcttagctcactgcatgctccgcctcccaggttcacgccattctcctgcctcagcctcctgagtagctgggactacaggcacccaccaccaagctggctaagtttttgtatttttagtagagacggggtttcaccatgttagccaggatggtctcaatttcctgacctcgtgatctgcctgcctcagcctcccaaagtgctgggattacaggcgtgagccaccgcgcccgggcagctgctcttataatggtggcttggtagtggcgaattctctcagcatttctttgtctgaaaaagactgtatctttcctttatatatgatgcttagtttcactggatacaaaattcttggctgataattgttttgtttgaggaggctgaagataaggccccgatcccttctagcttgtagggtttctgctgagaaatttgctgttaatctaataggttttcctttataggttatctggtgcttccatgtcacagcttttaagattcttttcttcatcttaactttggataacctgacaaaaatgtgcctaggtgatgatctttttgcaatgaacttcccaggtgtactttgtgcttcttgtatttggatgtctaggtctgtagcaaggcaggggaagttttcctccattattcccccaaatatgttttccaaacttttagaattctcttctttctcaggtacaccaattattcttagctttggtcatttaacataatcccagacttcttggaggctttattcatattttcttactcttttttctttgtctttgttggattgtgttgatttgaagaccttgtcttcaagctctgaatttctttcttctacttgttcaattctattgctgagactttccagagcattttgcatttctataagtgtgtccaatgtttcctcatgttttgattgttttttcttttttttctttttttttcttttttctgagacagagtctcgctctgtcacccaggctggagtgcagtggcgcaatctcggctcactgcaagctccgcctcctgggttcacgccattctcctgcctcagcctccccagtaggttgttttctctttaagctatctattttcttgaatatttctcccttcacttcttgcatcgttttttggatttccttgcattgaactttgcctttctctggtgactccctgattagcttaataactaacctcctgatttctttttcagggaaatcagggatttcttcttggtttagatccattgccagtgaactagtgtgatttttggggggtgttaaagagccttgttttttcatattaccagagttggttttctggttccttctcatgtgggtagcttctgtcagagtgaaggtctagggctgaaggctgttgttcagattctttttgtcccacggcgtattcccttgatgtagtactctccccgttttcctatggatgtggcttcctgtgagctgaactgcagtgatggttgtctctcttctgggtctagccacccagtaagtctatccagctctgggctggtactgggggttgtctgcacagagttctgtgatgtgaaccgtcaatgggtctctcaaccgtggataccagtgcctgttccagtggaggtggcaataggaggtgcaatggactctgtgagggttattagctttatggtttaatgctctattattgtgctggctggccttctgcagggaggtggcactttccagagagcatcaactgtgatagtatggagaggaacaagcaatggacaggtccctttaacatccaagattatatgcctttgtctcctgctaccagggtgggtagggaaggaccatcaggtaggggcagggctaggtgtgtctgagctcagactctccttgggccagtcttgctgcggccgctgtgggggatgggggtgaggctcccaggtcaatggagttgtgtacctaggaggattatgcctctgctgactcacgcaggttgtcagggaagtggggaaagctggcagtcacaggcctcacccagattccccacaaactgaggggccagtctcactcccaccatgcccccactaacagcactgagtctgtttccagctagtgggtgagccaggcttgacaacttgacccaggctacccacctcccagctgcaaaagaaaagggcttggttcttcccccacctgtggagtctgcacaccagattcccaccctcccctgagttctggccaggaggcttcttgacctattcacactgttacaaagttcagctggagacctccttctccctgtggagaaggaaatgttgtatctgggatatcacttcagtctgctgaaatctttctaaatcctgatcttgtcatccaacatagtcactaaccctctcagcaaatttgatcagtatattctgtgaatccatccatgtcattaataaaaacgttgactgggaccctgtgtcaggcctctgagcccaagctaagccatcatatcccctgtgacctgcacatacacatccagatggccagttcctgccttaactgatgacattccaccacaaaagaagtgaaaatggcctgttcctgccttaactgatgacattgtcttgtgaaattccttctcccggctcatcctagctcaaaagctcccctactgagcaccttgtgacccccactctgcccgccagagaaccccctttgactgtaattttcctttatctacccaaatcctataaaacggccccacccttatctccctttgctgactctcttttcagactcagcccgcttgcacccaggtgattaaaagctttattgctcacacaaagcctgtttagtggtctcttcacacggacacacatgaaaccctgcagcaaatgactacagacctcctgtaaagttgacgcagattcattaatcaccagtcttcacatgtgattgttcaaccagttacatatctgcttaactgttctgagctcacaggtctatatcctgctgaaactcactagctcagtaaccccatcaacaaaggaaatgggtttagtctggcataatttgtttcaagtgagttcctgttattttatgaaggttcatctggcaggatggatcctaaacccacactgcttctgctgacggtgtctgtacctaaggtgggagttgtgataacataataaataatctataatcacttgcataaccctaagaagccaggattaccaattacctacccaatacaaaacaaaaaatgaatatatgcaaaagaccagcctaaagtaagatggcaaaatttttctttggctctctgacacgttgctctcagccttcctctattgcacggtatcctctctttcctaccccatatgaatcctgtgacctcatgagaccctctgacttcccaaggctccccaccttggtattttatttcattcctgccctcccttaaatgctccaagctccaaaatgaacccttcctgaactcctccctccattctattttctcagatagataagacaaaaaacaactggactgtaagaattcacactaaagtatgaatgatgaattaccctgcaagaatgcaggtatttgtaaaataggaacatagtcaaccccaaataagctctacttagtggaattacaagccctgtgataaaatctgggtggaaaattgcaaacagaatttgacatatcttttgctgggggggcttttgtagtagtcaaggttcttggatataagtaacagaaaccttccctaattatcttaatcagaaatgagattggaaaaggtatcaggtatgtatactcagaactgatgaggaggcttggaagtcagacagaacccaagaaagactgggcagccgaaacctcatttggatcacacaacaaaaacatgctgtctagaaagccatggcaggctccactgctaatggaccttgactcgtactggactctaaatactgaatccctaggcacctgaatccctcctgctttaaacattttcaacccttcctaaaattcaaagaccaggcccaaagtgtccattggtcaaggctgggctgcatagccactcctcagtgccagggaacaagagaagagtattttccgttctttagctttcttaatgggagagtagtcctcctcactcttcctccttcttttaggattcagaagtagattatccaagagcatgagaaatgtctagtataactcctagaactccttaagttttacatatacttttaattacagtctgatcctgtatctgccccttctacagccatttgttggggttggggtgagcttgccaccttcaagagtcattgtggtagacaactgagtactgtatctgtttcttggtgggcaggcctacacaaacctgtccccagagtctgaggaagcctctcagctgctaaagaaagaggctaacaaatccagtttcttggaaagaacatttatttaataggaacttaacaaacagaagccatgtctgtgtctcaggcagtggcacgacaagatggatgatcctgcaccattaccccccagactgggtgtttatatactgtagaagaggagcacaagtgcttcagagagaacaggtaggaatgtgccataagggcagaatttacagtaagtaggaactcacccataaggaacaaaccaaaaatcttagaggccttcccagaagaggggtcaatcagaagccaaatggcgagttagcatctaagatagaattgctttggcctctatagtatcaccccacacgtatcccaagctcagcagtcagaatcttgacaaactttttttaaaaaaactgttggaatattccacacatacagaaaagtgcacagatcataagtgcactttcataaagcaaagtgaaatttcacaaagcaaacatatcttctgaagaaatattaccagcaccccaggtgcccccgatctgtgtcagttactaccttcccaaggtgaccactaccctggcacctggcacaactgatttttttctttgccttcaaattttgaaaaattgaattgtatggtattttctcttttagggctggattctttcactcgacattttgtttgtgacagtcatccatattgtatgtggttgtatttgaccaaccactttagaaagattgctgttgcactagccggctgtcccaagggggcctgggatttactgacaatcatatactgaggtcagctcagaaacaaaactctagacatttgttacattcacaagaaatctgggcaaccatgattagttctagtgaacttgaatatcacccttttgttatcctgtgctaaaaccagggagatctgagtaataatagtagtgatacagatataaggaatcccttagatttacaaaagtgttttacatgagcttaaaatgctctaacgagtgtcctcttggttcctaaaaatgcttgcaccagaaacagaattcaacttcccaataattaaaggacttcatatttggagttcagggagttctggccttgtgacagacaagaactcaccattcacctggacatgcccaagtgagtcatctctgtgtccagcgcagtggtctctaaacacataggtcatttgggataaactggtagtggagaaatcatggtaatgaggggaaagttactggtccagctagagataatgaaactggtttacaaagaggctgcagatggagacaagggaatgcattaagggatgggcaggcaggacgaggaatgctagatgatcagactaatacatttaagctcttccaaaaatgtgctccggaaaagcaatctccgtggagaaacaggttgaagattaaattgcccctccctgggggcacccgcagtcatacgatagtgcgcttgtggggtagagggatctggaggtgagaagccagagggagggctagcagggctctatgaggaggcagcattcctggttctcagctgtttgttttgtaaatggaagaagaaagtactttgcattccacaggtgtctgtggataaagccatcactttgcaaacctctgttcttaactcaaaccaacaggacaaagagtggttgctgcatgtctgcaagctgagtagtttgaagttagcgaggaaggcagtgagatggcagtagtcagaggggagtcagaagtctggtgctactggggaccaaagaagccatgaggggtcacaccttggctcggtgggctagcctttctccatgcgaatgtatctgtttgtctctgcttctcatcttcaacccagccccagactcaatgtcctttatggctctagatggtgatagagaaggtgaggcaaacaggaaaagcagaaggagaagaagcagagagaagaaagtgtctgagtcaagaagttgaaagacggccaagatgagggagagaaaggattgtgggaagagagcagggaggggcatcttagtcctgtgttgacacttcccccaaaatccattaattcccccacggtgtgagtggcagatgaggtgaaaccatgaaaagacatggaggggtaagcagggagaggctgtagtgggctgggagctaaagccctgcttcacacttcactgcagtgttcactcacatttgccttgtcactcactcttagcctattgagaatttttgaaaacgaaacttgatattcaaagttaagcactcttcaagtcaggtcaagagtctcaacaattatgtgcatctgcatatatgaggcactgttagaagttgtggagatatgaaaacgagaccaaagaatgtcttaccaaggagtgtaagacagatgatgttaagggccacaggagggtagatattactaagatgctgagagtcagcaaggggagagaactcacccagttggagtcagagaagcctaccaagaggaaggcatacttaagaagagcactgaaagataaggaatgcaataaggaattccaagtagaaggaaacacctcagctgggcaagggggctcatgcctgtaatcccagtgctttgggaggctgaggccggaggactgattgagcctgggagtttgaggctgcaatgatcacaccactgtgctccagcctgtgtgacagagcaaaaccctgtctctaaaaaatgaaaataaagaaggaaacaccttaaaccaagacccacaaatgaaaaagtactgggcatgttttaaatatgactgatgcttctgtgtagtcaaaggtctaaggagatgaggctagaaggaagagaagccatgttataaaggcatctgaatgtcagagtttggattttactttgcaggtaaacaggagccattgaaaatttttctgcagggaagttctatgaccaagtagcattttaagaagaataatctggcagcaatatatgtaagtaatcatcatgacaaggactgaagtcaaggaatcccgttagaaggctactagaatagtctagggggagtaatagcctaaactaggcttgtgtgtgtgtgcgtgtgtatatgtgtatatatatatatatgacatatatagagagacatatatatgagacatatatatagagacatatatatgagacatatatatgagatatatatagagacatatatatgtgacatatatatagagacatatatatgagacatatatatagagacatatatgagacatatatagagacatatatatgagatatacatagagacatatatatgagacatatatagagagacatatatatgagacatatatatgtagacatatatatgtgagacatatatagagacatatatatgtgagacatatatatgagacatatatatgtgagacatatatatgagacatatatatgtgagacatagatatgtgagacatagatatgtgagacatagatatgtgagacatatatatgtgagacatagatatgtgagacatatatatgtgagacatagatatgtgagacatatatatgtgagacatagatatgtgagacatagatatgtgagacatagatatgagacatagatatgagacatatatatatatacatatgagacatatatatgtatatatatgagacagggtcttgctctattgctcaggctggagcacagtggcatgatcatagctccataatcttagattcataagctcaaacaattctcccacctcagcctcccaaagtgctaggagtacaagcatgagccattgtggccaacccagatacatatatttttaaatgtttcattgataaaacctacagaacttagttattgattggatgtagttgatacaggaaaggaagtcttgactccaaggtgtgtgtccagagctgatagaagtgtaatggtgccattaacataaatttaaaaatcagaaagaagctcagaagtgtagggggaggggaggtctttgttttgggatgtattgaaatgtcagtagaatatttagataaaatgtctagccagtatttaaaatacagaaagtaaatgatttgtggctgaatatatagacataatgactagcttcatagtaataggagtagtaaaaatcacacacacaaaaaattgtaatgctgagtgttcagttcctgagcaaggagtgtggtagtttaagggaggggctgtcatcatccttgctttcaagttaaactgttaattaaattccccccaatgctagcttggcttatgcccaggaatgatcaaagatagcttggagatcagaagcaagaagagtcaactatgtcaggtttctgttaatgtcatagttatgaaaaggtggtctcatacggattttggatgagagagtttcttttcttttcttttttgtttgtttgtttgttttgttttgtttttttgaaatggagtctcactctgttgctcaggctggagtacagtggtgcggtctcggctcactgcaacatctgcctcccaggttcggcgattctcctgcctcagcctcccaagcagctgggattacaggagagcaccaccatgtccgactaatttttgtatttttcatagagacagggtttcatcatgctggcaggctggtctcaaactcttgacctcaagtgatctgcctgcctcgacctcccgaagtgctgggattaaaggcacgagccaccgcgcccggtcatgacgagagagtttctagttgaggggtgtttactgcctgtatatggaatgttaactgaaaactacacctatcactgaaggacataaaatgatcctgatacctgaaatacccatactgtctgggatgatgtcagataaatatgttaatgaggatggcagttcccagagttccatacttaaatagcaatggtttgtataggatcatgccacctggggaatgccagaaggagatactcacaggcacagatcttctttttccctaaaactgactctggaactacgtgaggagctgccagtttccatggttcctgataagcagttccctcactgacaaaaagctattggatttgtggatggcagtttcaaagtgaaaggaccacctcttgtttggaaggctgctcctctgattatttatcaaaatgagcctccaggccacacccagactcctggagctggtggggcagagcctgctgaggaaccagttcttggccatcttcaccctggaggagctgcccaaggaggtcttctgtctgctgttcactgaggcctccaccaggagatgctgtgagattctaaaggccatggtgcaggcctggcccttcccccgcctccctctgggttccctgatgaagacacctcatctggagaccttgcgagctatgctgaagagacttgatacactactggccagaaggttcgccacaggaggtagaaacttcaagtgctggatttgcgggatgttgatgagaatttctggaccatatggtctggagccagggccctgtcctgctccccagaggccatgagtatgaggcagacagtggtggactgtccaaggacaggagagcaccagcccttgaaggtgttcatagacctctacctaaaggaaaacaccctggatgaatgtctgcgctacctctgtgggtggatccactacagaagaggtttagtacacctgtgttgtagtaaggtacagaattactcaatgcccacttcaaatttcggaaatttattggaaaaggtatacccagacagcagtatccatgatttggaagtctggaaaaagtgctcgctgaatagaacaggaaagtttgccccttacctgggccagatgagcaatcttcacaaactctttttagccttcagttatgggtgtgagttatacatgtgcggccaacagcagttcattcctgacttggactctccattcctctgcctggaacccccagatgctttgaataagaaaggtcaataatatcaaagagcacctgctcaggtgcctcaagaaccccttggaggcctttacattctgtcatgcttacctagctgatcgggacatggggtgtcagtacccaagcctcagtcagctaaagcagctgcatctgattcatatcctaatgtggaccaccaatcttgagccccttggagctctgctagagaaagctgctgctactatcgagaccctcgtcttagaggactgtcggatccaggactcccaactcatggtcatcctacctgccctgagccgctgctcccagctcaccaccttctactttcatggaaatgagacctccatgaatgctctgaaagttctgttgcatcacacaggtgaactgagcaagttaggcctggagacatatcctgcccctctggagagtcttaacaacaggggtcatgtcagttgggagatcctcgccccaattcaggctgagctgatgcgtacactcagggaagtaaggcagcccaagaggatcttcttggtcctgccccctgcccttcctgtggctcatggccatctgagaaactggagctgcatcttcgcttctagggaaggcctggttagtggggtggataggctttctcccggacacttgggcactaaaatctaggacgtaggtacattttgttgttgttgttgttgttttgagacagagtctcactctgtcactcaggctgaagtgcagtggcacaatctcagctcactgcaacctccgcctcccagattcaagtgattctcctgcctcagcctcctgagtagctggtgttacgggcgtgcgccaacatgcccaactaatttttgtatttttagtagagacagggtttcacaagttggtgaggctggcctcgaactcctgacctcaagtgatctgcccacctctgccttccacagtgccaggtttacaggcatgagcagccgggcccggtcaggtgcatcttaaaggaagcacagagccagtgtgtttcaggcacgtgctcactgtgattagaaaaacaaaggtgactaagcaggggacagtactgggtgaaaatgctaacttggcgtccatgaggccttcagggacctgtgtcctagagtcagaacctgaagttctagagtgatgcaggagttactcccacaaggatggttatttaaaaatgtcaaaaataaatggaacctgaatggaaaaaaaaaaatcgtaattctaacacatagctgagaccaggaattaggctaagataattaagctaaaatatatacatatataaaatttttttaaaaagccctataaattatatgttgtttgtctttatctgttttgcattgctagaacagaatacctgaggctggatataaagaaaagagccttatttggctcacaattctggggactgggaggtccgagattgggcagctgcatctgttgagggcctaaggctgcttccactcatggctatcagtggaaggggagcagacatgtgcaaagaggtcacatggcaagaggggaagcaagagagagaaactgaggaagccagattctaaaagcccactctcaccagaactaatccatccccacaagaggaagaactgactcacccccacagagggcattaatctatttatgagagagctgcccctgtgaacccaaacctcccagcagatcccacctcccaacactgcgacattgggaatcaaattccaacacgagtttgggcagggacaaaccacatccaaactatagtactgttactatccatgcttagagatgaacagaactaggttagagagattaggtaaacgaggatttgaagccaggtattctgacttccaaagactgcactcttggccaccatgctttactgcatctgtaagggctattttgacagctagtgtgcagagaacacgtgagtggtggggaagtggatgcagtaggcagtggaatgaaaaagaacaaaagaacagaaggcagcaatggcaggacccaggggaacagatagaagcctaagcaaatgtataagtctggggagatcctgaagagaagcctaagaaaggctaattggcacagaaggacccaggaggaagttggaagggatggaattagaaggcctaggaaggagttagcctggtcaaagaaaagagagacttttctggaacaaagaaggaggaaggtgaaagtaccaaggaattctgaggagaagctgagagatcttagctgtcatggtcaaattttatcccccaaaaaatgttgaagtcctaacctccaatatctgcgaatgtgaccttatttggtgtctgctgttgatcaagtcaacatgaggccagtgggttgggccctaatccaatatgactgtatccttataaaaaggggaaaaatggacactaagacagagacatggggagaatgccatgtgaacctgaaggcagagatcaagatgatatgcctacaagtcaaggaataccaaatattgaaattgttctttttttttttttttttttgagatagtcttgctctgttgcccaggctgtagcatgatcttggttcactgcaacctccatctcccaggttcaagcaattttcctgcctcagcctctcgggtagctggaattacaggcacctgccaaatcacccagctaatttttgtatttttttagtagagacagggattcaccatgttagtcaggctggtctcgaactcctgaactcaagtgatccacctgcctcggcctcccaaagtgctgggattacaggcatgagccactgtgcctggcccagatattgcatttgaaatgcaatattgagaagacatccagaagctagaagtgaggcatggaacagattctccctcacagcccacagaaggaacacttgtatcttgggcttctggcctccagaactgtgataaaaaatttctgttgcttaagttactcactttgtggcactttttattatggcagccctagcaaactaatacagtgaccttgactttctcaagaaataggcaacttgttccccatatcacatagcttctgtaaagaaagacttctggctcggtccagggccaacccaggtgtggttggtggagataatattataagtgtagcacttgggccacagcttaggagaaatcaaatgggaaaagtctttttcccttctccctccagggactcgaacagcaactgatttcctcatccaacttgaccctccaaggtgtcctgggaacagggtgcaggagtgcaaggtaggcatgctccctgaactgagctgtaaggaacctggcttgctttggtcaaggataggccgaggtaaacgttcagagtgactcagtgagtttagagcgcaggcgtataactccacttgttgtcatgccatgtagacataacatagagaagctcaccaccatagtcataatatagggaaggctcatcacttggctttaagccgctattgtctataaaaggtataattgctttgccgacactgtacaggcacactggtgtccagagaaagagccaaagctgtccatctttgcagatggacagaggggagccaggatgcagcttggctcactcatgtccagagagagaaagagttaagctgctgaccctgaaggcaaaggagagccaaccatgcagctgtgtgtgggagccactgaactaaccagctgagacagggtggacagtgtgagaaagctgttgatgagagctgatgctgaataaaatcatctttcacctgcctacagccccccaagtgttctttcttctcatccacccactcccttcggactgcaacatgacatttggcataatcgtgaacctgacataagcataactgaggcaggcagatgtaagacctgagtgtgcaaagggcccttctagggtggaatttatacctatggccagggcactgagacatccagctcaccctggatgtcgccattagcatagctcacttggcatttgaggttacattagatcccttgaggtattgttgtgaggctggctttttttttttctttgaggagaaaaaggaggaattcatttttattttcacaaggtctccagaagcctgggttggtgcaggtgggaatgtgcagctgacattgaagcctgtgggagggtgggaaggagccccactggggataacacacccctggcccccacttagcttttactcctatctcggtggtctatgagtcttttgtccccagtagccctactggtcagggactgtgtctcattctttttgatggccccacagtgcctaacctagcgcctgacacagtcagtccccagtgaatatagagtagtggctcaatagcttcttcaatattagaacaatgatgaatgtttccatgtttcccattccaaaagcagatttagaacactgacacccatttagaagcaggatcaaagcccacagcataagggctattctgacactgttgataccacctattccagcacaccaccttccaaggtcaaaagcaactgctcccctccatttcccagctgtcctgcctgggaaaaacaggattgtaacagaacaggaagtattaagtaggaaaacactagaagttagaattgtaaaatgtagtaacacactagatgcctgaagactccttaagcaggcctgatggaaagctgggaaggaggagggacaattgtgaaagagaccaaaagaccaggtgcttgaaaaactttggttccctgactaattagtggagtcaaatggaaagacagcccaagagaggacattgcgggtaaggtggaaatggaaaccaggccattaaaaatatataaagaagagccttgcaaggaactccataatcaataacaaagacacatacccctgaacataaaataaaagtttgaaaaaaaaaaaaagacgtgaaagagagaaagccagctaaggactcaccaacagcaatgacacctccggtgcagatagcactttataaggtgctttcatgtataacaacatagagagtaagataggactttgtattcccactttatagagtgggcagctgaagttcagagagggcatataatttatctacagtcacacagctggtaagtggcagagcctgttctctagcactcagaatggaaaaggattcagtgaataggctgaaagaattctttatctttgtctcaccaaaggaggtggtaaatttgccactaaaatagacaaataaatatgttctccctaccatgcagcagcagcacagcatagctaaggcatggtttctggagtccaacagacctaggctccagccgtagctcttctacctactaatgagagaccaggaacaagctgtttaatctctcagaacttaatttccacaactgaaagataggaataatactagagttattttgaggggggaaaacatggttgtgtatgtaataaaattgctaatatttataaagtgcttagtgttttctttttctttctttttttttttttgagatgaagtctcgctctgtcacccaggctggagtgcagtggcactatctcggctcactgcaagctccgcctcccgggttcatgccattctcctgcctcagcctcccaagtagctgggactacaggcgcccgccaccatgcctggctaattttttatttctagtagagacggggtttcaccatgttagccaggatggtctcaatctcctgacctcgtgatccacctgcctcagcctcccaaagtgctgggattacaggcgtgagccaccacacccagccaggtttttttaacaataacatgttttctattgaaaacttaaagtaaattttaacaccaagtctcccaattttgggtgaaacaagcacaccctcctttcccctcccaccctcaccgttcttttcaccatctcctggaaagatcaagaaggaagggtttgagggggctggttaggtgcccaggccaggtgggcctgtgggagctctgaccactcatctagcagcagttaagcatttatctgaaatggatgctgcagatggatggagaatccttctgcaaagactagcacagtctgaggtgatgccagggagctctgccccacatttcagtcccccaaagccatcccaccatgctaccactttctttgaggcccaaagagcttctgtcttctcaaaaggccccctagtaaaaatggaagtatttctgtaggtgttaagcatatcagctaacacttttcttatcagccacagcacctttgttatcagcgaacaccttggctcaaattacttgacaactttcagagtgtgtgtgcacagaagaaacccctgttttgtccctggtagaggaaggtgaagggtggcaataagggtttagggaatgcaaagtgaacagggagaatttttagaggagacccaagataatgctttgcttgccctgcactcatgagagaggggacagggggagatgcaagaggtgcgtgtgttcgtgtgtgtatgtgtttgtgtgtgttatataatctgtgtaaggactcctgggaagcagacatcaagttctgagaagaggattgcagagaagtttgcatggcctgaatggggagtgtagaccctcaagggatgcctgaatctgttgttgtaaaatgttttaaatcaatcatttaaaaaatttatttaataactagcctctctcctaatacccaatttgtacttgcttcacttatgaaaagccatttgaatatttaccttccaaatcagatcattctgagcatccagtcagtagttacactatgaaaaacttgttaacaggcaagagaggctatagtttatagccagcacctggtagctgggaacagtgagctatgacagatgcagggggaggggatgtgtcctgtttcaggggctgatcgttgataccagatcctgctccccaaatcacacctctcaaatattagctcagcgtagatggcatccacacctcctctctctcatagtaagggaatcaggggcatctccaggtgtatactccacctagctctcagcatcattcactccattttgttctcctaagttctcctaggaatcttccactaatatattttagtgtggctccagggaataaaagagacaaaaccaatggcttactgagaataatattttaagtgatatttaatgcttcagataattggtcataacaagataaaaggtcagtttaccaaattatagatacaatgttatcccaacactataaaaatatactgttacgtatatatgtatatgtaaaagaaaatacatgaaaatattaacctggttaatattaacattaacaatggatatctctgcgcactgagactgagggtgacttctgttagctttcctcaagtccattcacttctctccaggtctttggcatcacctagtcatgtcactatcatctccctcctgatcttctacagtaacctcctaaatgatcagcctgcagctggtcttaccaattcactccccacacagaatcaagactgaacttcttcaaatgcaaatctggtgaccatggagacaggatgacaaactggcaccagctgcttgctccttccatgaaacccaaccctagagatgtccaagaagcaaacgtgagcttattagattcaatgcttattgcaaaaactatttttttggtttgtatgcttgtttgttgattggtagggagttaaaggttggttaggttttggagttgtcacaaggacagaaaatggcagcctacagcagacaagggctagaaactttggacagtatattagcttcctattgctgtgtaacaaattattgcaaatttagcaccttaaaacaacatacttttagcgtctctcagttcctgtgagtcaggcatccagacatggctcagctgggccctttgctcagggtttcacaagtctgtgatcagtgtctggactgcatttctttctggagctccaagttctccttctcagctcatataattgtcagcagagttagttccttgcgtttgtaggacagaggtccctgctctcttgctggctgtcagtaagggccactgtcagctcctagaggcccccacagttccctgtcatatggctttctgacaacctggccacttacttcttcaaagccagcagggaagctcactctatctccatcttactaagatggaatcttatataatgtaatataatcacagtgtgactattccaccatattcacaggtcctacccacattcaaggggaggagactataaagggtgtgtataccaggagacaggaatcctggggatcatctcagaattccacctaccacaatttgacctctggcctccagtaattcatattcctcccacatgaaaaatacattcaccttatctgttacaggctaaattgtgtcgcgcaaaattcatacatgaaagtcctaactcccagtatgtgactgtatttggaaatagagtctttaaagaagtaattaaaggtcgggcgcagtggctcacacctgtaatcccagcactttgggaggctgaggcaggcagatcacgagatcaggagatcaagaccatcctgtctaacatggtgaaagcctgtctctaccaaaaatacaaaaaactagccgggtgtggtggcacacatctgtagtcccagctactcaggaggctaaggcaggagaatcgcttgaacccaggaggcggagattgcggtgagccgagatcacgccactgcactccagcctggacaaccgggtgagactccgtctcagaaaaacaaaaataaataaatgaataaatgaataaataaataaataaatttaaacacagaatgactcaaaatatacgtttgcttgtttttgaaaaaaaaaagaagtaattaaattgagatccttaggatgggccctaatgtaacatgactggtgtccttatacaaagtagaaatttgggcatagatgtatacaaaaggaagaccgtgtgaagacacagagagagacaggcatctataagccaaagatatgggccctcaggaaaaaaaaaaaaccctgccaatactttcatttcagacttctaacatccagaattgtgagaaaaatcatttctgtcatccaggtcacccagtttgtggtactttgatttggcagccctagctgactaatacaccatcccagcatcttcatcccattacatcatcagcaaaatctcttcatcaaatctcatctcatcagctcaaaatccaaaatctcattatctaaatcatataactcaggtacagacagggatcctgggtacagtctattaagtacaattcctggggcacaatttctctccatttaagaacctgtaaaacttaagagacaaattatctacccacaaggtacccaacatacaatgttcagatagacataggataattgctatagacatcctggttcaaaaatgggagagatgagagataaataaaggagtcacctgtccatcacagtattgaaattcagccaagcaaatattacatttccttgattaagtttcaaggaatgggaatagagactgtttagctctctaacctctgaactctgcactctggtctctgagtcatctttcctttttgacaaaaggtagctcatgtttgcagctgagtcattttaatcagtccactttctgccagtagctcagagtcctctttcaagcctggtgtagaaagctagaactagcatatagagtgaggagggcatatttgcaggtgaggggctagcaacgaaaataggagattggtctcgtacaggaacactggtcacataattaaatatattaaagatattgagagccaggtttcttaccatcagaaaatggattaacaaatatgaaaaatgagaaatatagaatgaactctgtggttttggattggaattggaagtatccgtttgcaatatatagagagaaatataaaaatatagatataaacgtgtgtgtatatctatatatatttcttagctatgtccactgagaagtcctgggaagtgaaacaccccaaaagcaagaaccaaacctgttgcccagatgcgggcttctcaacatcattctctacttgaaggaaccaggcctcttcagagaaatgtcttgagtttaaggcttgggcagggaaagtatgaggtgagctcataacattttttcccctcagaaggcaagaaagtactcaaagaatgataggactatatcaaaagcacacaaacaccagcttgaagaggcttccaatggccaaactggagacaatttgagtatcaaagaatgatagtaacagatcataattcattgaataaaataggaaaccatgagcccatacaggtataaaacaataaataaattaattaaaagtttgttcaggaatagaatagttacaaagcttcaacatttttcacacaaaatattcattaattacaaaaagaagtaacttgaaaccggagactagtagacatcatcttaataaagcaactcttggctgggagcggtggctcatgcctctaatcccagcactttgggaggctgagatgggtggatcacctgaggtcaggagtttgagaccagcctggacaacatggtgaaactgcatctctactaaaaatacaaaaattagccaggtgtgatggtgcgtgcctgtaatcccagctactcaggaggctgaggtaagagaatcacttgaaccctggaggcagaggttgcagtgagtcaagatcacgccactgcactccagcctgggcaacaagagcaaaactccgtgccaaaataaataaataaataaataaataaagcaaccaaaattgacatcatcaataatgggaaaaattgaagttttgcactacctggcatgatgcactgagaagaacacagtatcacttctatgttattctttccaaagatgcataacccaagtctattctgaggaaacagcagatggctctgaattgagagacattctacaaaataactggcctacaatcttcgaaagtggcaaggatatgacagtcaaggaaagatgaggaaccatttcaaattgaagttagccaaagatgtgatacatgcagcattttgaactggatcctcttgctataaagagtattattgcaacacttggcaaaacttggaatgggatctgataaaaatgattcatcaaggttaattttcttttttcttttttttttcttttttatttaagtcacaggatttcactctgtcacccaggctgaagtgcagtggcacaatcacagctcactgcagcctcaacctcccaggctatagtgatcctcctgcctcagccccctgagtaactgggaattgtattgtatatactatatatagtctatataagcatatggaagaatgtctttgtaggaaataaacactgaagtttttgggataatagggaatcaggttagcagcttattctcaaagggttaaggaaaaacagttacttctaccatacttgtacgtttttagtgtgactgtaatcctttaaaaatatttaatttaaaagtatactaataaataaacgggccatggtttgactacttttgggcaggctgtcctctcactccagcttgtaggccatttcagggcctgttgggttggagaccaatagttcgttgccagtctcaggcaggaaaattgaactgattttgtccatgcatcagcagctgcctgaacgtggctcaagatttcctgcctggccacatttctggttaaacttcactgacaaatcattctcactgctctcaaaatatttccccatgtgtaacggagtcaccaaatcaaagacttaggtctggctctaaaatctctcacattctttagactacagctctctgtctgtccctgaatcttcctaaaccagccaggcacccagggctcctcaggaatgatttacttgctattatattgtggggaatgtggctgacttttgcaagagatttcctgtcttctctcaacaagtgactaaactggttacagctaattctgctgggaagtaaccagctgtttttccacaatgctgcagccatttccatgaattaatttgggagtattgtagacccttgaagcagcataaggctctggtgcctatagctttagtaggatttagcatcctcagcaatgggctgaatataaagaaacataaaatctattaacggctgctcctgaaaatgcctgtgcagtcttgggtgaggtaaagaatctccctattcttatgagtgatgaaatgatagcaccactaacccatacctattgtcaaggtgtgtgtgaggataaacagagtgtatttggagagtcttgaattctatattaagagaatgtagtatagccatattgccatatttattcagtgttaatagcaggaagcaatttaaaatcctagccctgctaaataaaggaagaattattattactaacaattacatttagataatagtttgtgttcagccacttatttatatactcagcacacattcactgaacacatactctgtgctggtcactgtataggcacaaaggatgtaactgtgaacaggacagcacagtccttgccctcatggtgcatagagccaaatgaggaactgtgcaactagccacttcttgcaagtttgaggagtaataaaaagaaaaaaaaagaacttaattttcaatgaaaatgactattattattaggcaagtgaaaaaaaaatcataggcttggaagtcagaagaggatttgagacctggatctcctgcttactgctatgtcagcctcaaaaagttacttaaattctggtcgcctgggcaagatggccaactagtgacagctccaggctgcagctcccagcgagatcaacacagaaggtggatgatatctgcatttccaactgaggtacccagctcatcttattaagactggttagacagtgggtgcagcccacagagggcaagcagaagcagggaggggtgccacctcaccagggaaacacaaggggtcagggaagtccctccccttgccaagggaagtcgtaagggactgtaccacgaggaatggcgcattctggcccagaaaccatgcttttcccacagtctttgtaacccgcagaccaggagattccctcaggtgcctacacctgggtttcaagcacaaaatttggtggccgtttgggcagacacagagctagctccaggagtttttttcatactccagtggtgcctggaacgctagcaaaacagactgttcactcccctggaaagggggttgaagctggggagccaagtggtctaactcaatggatcccacccccatggctaagacccactggtttgaaattcttgctgccagcacagcactctgaaattgacctgggatgctagagcttggtggggggaggggcatctgccattactgaggcttgagtaggcggtttttccctcacagtgtaaacaaagccgctgggaagttcaaaatgggcagaacccaccacagctcagcaaagctgctgtagccagactgcctctctagattcctcctctccgggcagggcatctctgaaagagaggcagcagccccagtcaggagcttatagataaaactcccatctccctgggacagagcacctgggagaaggggcggctgtaagcgcagcttcagcagacttaaacgttcctgcctgccagctctgaagagagcagcggatctcacagcacagcgctcaagctctgctaagggagagactgcctcctcaaggcacctcctccagtgcctcctgactgggagacacctcccagcaggggtcgacagaaacctcatacaggagagtgacagctggcatctggtgggtgcccctctgggatgaagcttctggagggaggaagaggtagcaatatttgatgttctgcagcctccgctggtgatagccaggcaaagagggtctggagtggacttccagcaaactccagcagacctgcagcagatggtcctgactgttagaaggaaaactaacaaacagaaaggaatagcatcaacatcaacaaaaaggatgtccacacaaaaacccaacagaaggccatcaacatcaaagaccaaaggtagataaatccatgaagatgaggaaaaaccagtgcaaaaaggctgaaaattccaaaagccagaatacctcttctcctccaaaggatcacaactgctcactagcaagggaacaaaactggacagagaatgagtttgatgaattgacagaagtaggcttcagaggtgggtaataacaaactcctctgagtgaaaggagcatgttctaacccaatgcaaggaagttaagaaccttgaaaaaaggttagaggaattgctaactagaataaccagcttagaaaagaagataaatgaccggatggagctgaaaaacacagcacgagaacttcgtgaagcatacataagtattaacagccaaatcaatcaagcagaagaaaggataaaagagattaaagatcaacttaatgaaatcaagcatgaagacaagactcaagaaaaaagaatgaaaaagaatgaacaaagcctccaagaaatatgggactatgtgaaaagaccaaacctatgtttgattggtatacctgaaagtgatggggagaatggaaccaagttggaaaacactcttcaggatattatccaggagaacttccccaacctagcaaggcaggccaacattcaaatttaggaaatacagagaacaccacaaagatactcctcgagaaaagcaaccccaagacaaataattgtcagattcaccaaggttgaaatgaaggaaaaaatgttaaaaggagcaagagagaaaggtgaggttacccacaaagggaagcccatcagattaacagtgggtctctgcagaaaccctacagccagaagagagtggaggccaatattcaacattcttaaagaaaagaattttcaacccagaatttcatatccagccaaattaagcttcatgagtgaaggagaaataaagtcctttacagacaagcaaatgctgagagattttgtcaccaccaggcctgccttacaagagttcctgaaggaagcactaaacatggaaaggaaaagccagtaccagccactgcaaaaacataccaaattgtaaagaccatcaatgctatgaagaaactacatcaactaatgggcaaaataaccagctagcatcataatgataggatcaaattcacacataacaatattaaccttaaatgtaaatgggctaaatgcccccaattaaaagacacagactggaaaattggatagagtcaagacccattggtgtgctgtattcaggagacccatctcacatgcaaagacacacttaggctcaaaataaagggatggaggaagatttaccaagcaaatggaaagtaaaataaaagcatgggttgcaatcctagtcacagataaaacagactttaaaccaacaaagatcaaaaagacaaagaagggcattacataatggtaaagggatcaatgcaacaagagagctaactatcctaaatatatatgcacccaatacaggagcacccagattcataaagaaagttcttagagacctaaaaagagacttagactcccacacaataatagtgggagactttaacaccctactgtcagtattagacagatgaacaagacagaaaattaacaaggatattcaggacttgaactcagctctggaccaagcagacctaatagacctctacagaactctccaccccaaattaacagaatatacattcttctcagcaccacatcatacttactctaagattgaccacataattggaagtaaacactcctcaacaaatgcaaaagaacggaaatcataacaaacaatctgtcagaccacagtgcaatcaaatcagaactcaggaataagaaactcactaaaaaccgcacaactacgtggaaactgaacaacctgctcctgaatgactactgggtaaataacaaaattaaggcagaaataaatgagttctttgaaaccaatgagaatgaagacacaatgtaccaggatctctgggacatatttaaagcagtgtgtacagggaaatttatagcactaaatgcccacaagagaatgcaggaaagatctaaaattgacaccctaacatcacaattaaaagaactaaagaagcaagagcaaacaaattcaaaagctagcagaaggcaagaaataactaagatcagagcagaactgaaggagatagagtcacgaaaaacccttcaaaacatcaatgaacccaggagctcattttttgaaaagatgaacaaaatagatagatggctagccagactaataaagaagaaaagagagaagaatcaaatagatacaataaaaaaatgatgaaggagacatcaccactgatcccataggaatacaaacaaccatcagagaatactataaacacctctatgcaaataaactagaaaatctagaagaaatggataaattcctggacacatacaccctcccaagactaaaccaggaagtcaaatccctgaatagaccaataacaagttctgaaattgaggcagtaattaataccctaacaacaaaaaaaagcccaagaccaggtggattcagagccaaattctacaagagctaccaagaggagttggtaccattccttctgaaactattccaaacaatagaaaaagagggactcctctctaactcattttatgaggtcagcatcatcctgataacaaaacctggcagaggcacaacaaaaaaagaaaatttcaggacaatatcactgatgaacatcaatgtgaaaacccccaataaaatactggcaaactgaatccagcaccatatcaaaagcttatccaccatgatcacgtcagcttcatccctgggatccaaggttcaacatatgcaaatcaataaacagaaccaatgacaaaaaccacatgattatctcaatatacgcagagaaggccttcgacaaaattcaacactcctttatgctaaaaactctcaataaactaggtattgacgtaacgtatctcaaaataataagagctatttatgacaaacccacagccaatatcatactgcatgggcaaatgctggaagcattccttttgaaaaccagcacaagacaaggatgccctctctcaccactcctattcaacattctggccagggcaatcaggcaagagaaagaaataaagggtattaaaataggaagagagaaagacaaatggtctctgtttgcagatgacatgattatatattcagaaaactccatcatctcagcccaaaatctccttaagctggtaaacaaattcagcaaactctcaggatacaaaatcaatgtgcaaaaatcacaagcattcctgtacaccaataacagacaagcagagagccaaatcatgaatgaactcccatttacaattgctacaaagagaatacaatacctaggaatacagctaacaaggggagtgaaggacctctttaaggagaactacaaaccactgctcaaggaaatcagagaggatgcaaacaaatggaaaaacactccatgctcccagacaggaagaatcaatatcatgaaaatggccacactgcccaaagtaatttataaattcaatgctacacccattaaactaacattgacattcttcacagaattagaaaaaactattttaaaattcatatggaagcaaaaaagagcctgtacagtcaagacaattgtaagcaaaaagaacaaagctggaggcattacactacctgacttcaaactatactacaagtttacagtaaccaaaacagcatggtactggtactaaaacagacacatagaccagtggaacagaatagagactcagaaataagaccgcacatctacagccatctgatctttgacaaagctgacaaaaacaagcaatggggaaaggattccctatttaataaatggtgctggaacactggctggccatgtgcagaaaatcaaaactggtacccttctttgcaccttatacaaaatttaactcaagatggattaaagacttaaatgtaagacctaaaaccataaaaaccctagaagaaaacctaggcaataccattcaggacataggcatgggcaaagacttcatgtctaaaacaccaaaaaaaaaatggtaacaaaagccaaaattgacaaatgagatttagttaaactaaagagcttctgcacagcaaaagaaactctcatcagagtgaacaggcaacctatagaatgggagaaaatttttgcaaactatccctctgacaaagggctaatatccagaatctacaaggaacttagacaaatttacaagaaaaaaacaaacaacctcatcaaaaagtgggcaaaggatatgaacagacacttctcaaaagaagacatttatgcagccaacaaacatatgaaaaaaaaagctcaccatcattggtcattatagaaatgcaaaacaaaaccacaatgagacactcatctgacaaagggctaatatccagaatctacaaagaactcaaacaaatttacaagaaaaaacaaacaaccccatcaacaagtgggtgaaggatatgaacagacacttctcaaaagaagacatttatgcagccaacagacacatgacaaaatgctcatcatcactggccatcagagaaatgcaaatcaaaaccacaatgagataccatctcacaccagttagaatggtgatcattaaaaagtcaggaaacaacagatgctggagaggatgtggagaaataggaacacttttacactgttggtgggcgtgtaaattagttcaaccattgtggaaggcagtgtggtgattcctcaaggatctagaaccagaaatatcatctgacccagccatcccattactgggtatatgactcactacactccacggaagcaacatgaagtgatctgctgcagtactctgagccctgggattcatttttctcttcactgtgggtggcctaaccggcattgtactagcaattactaggattataaatcatgctactataaagacacatgcacacatatgtttattgcagcactattcacaatagcaaagacttgcaaccaacccaaatccccatcaatgatagactggataaagaaaaagtggcacatatacaccatgaaatactatgcagccataaaaaaggatgagttcatgtcctttgcagggacatggatgaagctggaaaccatcattctcagcaaacgaacataggaacagaaaatgaaacattgcatgttctcacttataactgggagttgaacaatgagaacacatggatacagggcggggaatatcacacaccagagcctgttgtggggtgagggcctaggggagggatagcattaggagaaatacctaatgtagatgatgggttgttgggtgcagcaaaccaccatggcatgtgtatacctacgtaacaaacctgcacgctctgcacatgtatcccagaacttaaagcataataataaaaaaaaagttacttaacttcgaatagccttgatttcatcagcattctctgagaatccatatagcaacatctgtacagcctctctcatgaggttgttgtgaagctcaaatgagataaccaatgtgaaagcacttgcaaaactcatagatgagagtttttaagccctgccaggtgccagaagatgtgactgtccccagacattactgatccaccaccacccaccactgcccactggcctcatctctgtcctgttcagtatgtttaacaacatatgggatgaaaacataagatgtttattaatatacagcacaaatgaagctaaaaatagaaaatacaaagaatgatggattgatctgttccaagatggccaaataaggacagcttcagtcttcagttcccagcatgattgacacagaagatggatgattcctgcatttccaactgaggtgcctggttcctctcactgggactggttggacagtgggtgcagcccacagagggtgagccaaagaagagtgggcatcacctcactcgggaagttcaaggggttgggggatttccctttcctagccaagagaagtcagaaccgactgtacctggaaaaatgggacactcccacccaaatagtgtgcttttcccaaggtcttagcaaccagcagacaaggagattctctcctgtgcctggctcagcgggtttcatgcccatggaaccttgctcactgctagcgcagcagtctgagatcaaactgcaaggtggcagcctggcttggggaggaacgttcaccattgctgaggcttgagtagataaacaaagtggctgggaagctcgaactgggcggagcccaccacagctcagcacagcctactgcctctatagactccacctctgtgggcaaggcatagctgaacaaaaggaagcagacagcttctgcagacttaaatgtccctgtctgacagctctgaagagagcagtggttctcccagcctggtggttgagctccaagaacaaacagactgcctcctcaagtgggtccctgatccccgtgtagcctaatggggagacacctcccaataggggctgacagacacttcatgtacgcaggtgcccctctgggacaaagcttccagaggaaggatcaggcagcaatatttgctgttctgcaatatttgctgttctgtagcctccactggtgatacccaggcaaacagggtctgaagtggacctccagcaaactccaacagacatgcagctgagggacctgactgttagaaggaaaactaacaaacagaaagcaatagcaccaacatcaacaaaaaggacatctacaccaaaaccccatctgtaggtcaccaacatcaaagatcaaaggttgataaaaccataaagatggggagaaaccagagcaaaaaagctgaaaattctaaaaaccggagcacatcttctcttccaaaggatcgcagctccttgccagcaatggaacaaagctggacggagaatgactttgatgaattgacagaagtaggcttcagaaggtcataataacaaacttctccaagttaaaggagcatgttcaaacccatcgcaaaaaagctaaaaaccttgaaaaaaggttagacaaagggttaactagaataaacagtgtagagaagaccttaaatgacctcacggaggtgaaaaccatggcatgagaactttgtgatgcatgcacaaccttcaatacccgattccatcaagtggaagatagggtatcagtgattgaagatcaaattaatgaaatgaagcaacaaaacaaggttagagaaaaaagagtaaaaagaaacaaacaaagcctccaagaaatatggaactatgtaaaaagatcaaatctatgtttgataggtgtacctgaaagtgatggggagaatggaaccaagttggaaaacactcttcaggatatcatccaggagaacttccccaacctagcaaggcaggccaacattcaaattcaggaaatacagagaacaccataaagatactcctcgagaagagcaaccccaagacacataattgtcagattcaccaaggttgaaatgaaggaaaaaatgttaagtgcagtcagagagaaaggttgggttacccacaaagggaagcccatcagactaacagtggatctctctgcagaaaccctacaagccagaagagagtggaggccaatattcaacattcttaaagaaaagaattttcaactcagaatttcatatccagccaaactaagcttcaaaagtgaaagagaaataaaatcctttacagaccagcaatgctgagagattttgtcaccaccaggcctgccttacaagaggtcctgaaggaagcacttaacatggaaaggaacaaccagtaccagctactacaaaaacatgccaaattgtaaagaccatcaatgctatgaagaaactgcatcaattaacggacaaaataaccagctaacatcataatgacaggatcaaattcacacataacaatattaaccttaaatgtaaatgggctaaaagacacagactggaaaattggataaagagttaatacccattggtgtgctgtattcaggagacccatctcatgtgcagagacacacatagactcaaaataaagggacggaggaagatataccaagcaaatggaaagtataaaaagagcaggggttacaatcctagtctttgataaaatagactttaaaccaacaaagatcaagagacaaagaaggccattacataatggtaaagagatcaatgcaacaagaagagctaactatcctaaatgtatatgcacccaatacaggagcactcagattcataaagcaagtccttagagatctacaaagagacctagactcccacacaatcataatgggagactttaacaccccactgtcaatattagacagatcaacaagacagaaggttaacaaggatatccagaaaaacagacctaatagacatctacagaactcttcaccccaaatcaacagaatatacattcttctaagcaccacatcacacatattctaaaattgactgcatagttggaagtaaagcactcctcagcaaatgtaaaagaacagaaatcaccacaaactgtctctcagaccacagtgcaatcaaattagaattcaggattaagaaactcactcaaaactgcacaactacatggaaactgaacaacctgctcctgagtgactactgggtaaataacaaaattaaggcagaaataaagatgttctttggaaccaacaagaacaaagacacaacatagcagaatctctgggacatatttaaagcagtgtgtagagggaaatttatagcactaaatgcccacaagagaatgcaggaaagatctaaaattgacaccctaacatcacaattaaaagaactagagaagcaagagcaaacaaattcaaaagctaacagaaggcaagaaataactaagatcagagcagatctgaaagagatagagacacaaaaaactcttcaaaaaatcaatgaatccaggagcttgttttttgaaaagatcaacaaaattgatagactgctagcaagactaatacagaagaaaagagagaaaaatcaaatagatgcaataaaaaataataaaggggatatcaccactgatcccacagaaatacaaactatcatcagagaatactataaacacctctacgcaaataaactagaaaatctagaagaaatggataaactcctggacacatacaccctcccaagactaaacaaggaagaatttgaatctctgaatagaccaataacaggctctgaaattgaggcaataattaataacctaccaatcaaaaaagtccaggacctgatggattcacagccgaattctaccagaggtatgaaaaggagctggtaacattccttctgaaactattccaatcaatagaaaaagagggactcctccctaactcaatttattaggccagcatcatcctgattccaaagcctggcgagacacacacaaaaaaagagaattttagaccaaaattcctgatgaacatcgatgcaaagatcctcaataaaatactggcaaatgaaatccagcagcacaccaaaaaccttatccaccacaatcaaattggtttcatctctggcatgcaaggctagttaaacatatgcaaatcaataaatgtaatccatgacataaacagaaccaatgacaaaaaccacaggattatctcaatagatgcagaaaaggccttcgacaaaattcagcagccttcatgctaaaaactctgaataaactaggcattgatggaacatatctcaaaataataagagctatttatgacaaatccacagctgatatcatattgaatgggcataaactggaagcattcccattgaaaaccagcacaagacaaggatgccctctctcaccactcctgttcaacacagtgttggaagttctggcccagaaaatcaggcaaaagaaagaaataaagggtattcaatcaggaaaagaggaagtcaaattgtccctgtttgtagatgacatgattgtatatttagaaaaccccatcgtctcagcccaaaatctccttaagctgataagcaacttcagcaaagtctcaggatacaaaatcagtgtgcaaaaatcacaatcattcctatacaccaataacaaacaaacagagagccaaatcatgagtgaactcccattcacaattgctacaaagataataaaacacctagcaatgcaacttacaacggatgtgaaagacctcttcaaggagaaatacaaaccactgctcaatgaaataaaagaggacacaaacaaatggaagaacattccatgctcatggataggaatcaatatcatgaaaatggccatactgcccaaggtaatttatagattcaatgctatcccatcaagccaccaatgactttcttcacagaattggaagaaactactttaaagttcatatggaaccaaaaagagcctgcattgccaagacaatcctaagcaaaaagagcaaagctggaggcatcatgctacctgactttaaactatactacaaggctacagtaatcaaagcagcatggtactggtaccaaaacagatatatagatcaatggaacagaacagaggcctcagaaataacaccacacatctacaactgtctgaactttgacaaatcttacaaaaacaagcaatggggaaaggattccctatttaataaatggtgctgggaaaactggctagccatatgtagaaagctgaaactggatcccttccttacaccttatacaaaagttaactcaagatggattaaagacttaaatgtttgacctaaaaccataaaaaccctggaagaaaacctaggcaataccattcaggacatatgcatgggcaaggacttcatgactaaaacaccaaaaaaaaaaaaaaaatggcaacaaaagctaaaatagacaaatgggatccagttaaactaaagagcttctgcacagcaaaagaaactctcatcagagtgaacaggcaacctacagaatgggagaaaatttttgcaacatacccatctgacaaagggctaatatccagaatctacaaagaactccaacaaatttacaagaaaaaaacaaccccatcaaaaagtgggcaaaggatataacagacacttctcaaaagaagacatttatgcagccaacagacacatgaaaaaatgctcattatcactggtcatcagagaaatgcaaatcaaaaccacaatgagataccatcttacgccaattagaatggtgaacattaaaaagtcaggaaacagcagatgttggagagggtgtggaaaaataggaatgcttttacgctgttggtgggagtgtaaattagttcaaccattgtggaagacagtgtggcgattcttcaaggatctagaaccagaaataccatttggcccagcaatcccattgctgggtatatactcaaaggattataagtcatgctactataaggacacatgcacatgtatgtctattgtggcagttttcacgatagcaaagacttgcaaccaacccaaatccccatcaatgatagactggattaagaaaatatagcacatatacaccatggaatactatgcagccataaaaaaggatgagttcatgtcctttgcagggacacggatgaagctagaaaccatcattctaagcaaactatcacaaggacagaacaccaaacaccgcatgttctcactcataggtgggaactgaacaatgagaacacttggacacaggacagggtacatcacacgctggggcctgttgtggagtgggggcctcggggagggatagcattaggagaaatatctaatgtaaatgacgagttgatgggtgcagtaaaccaacatggcacatgtatacctatgtaacaaacctgcacattgtgcacttgtaccctagaacttaaagtatatataataaaacaaaaaacaaaacacaaaaaaagaatgatggagccaggatccaattatctcctcaggataacaagatgaaatagaatcacgatacatgtaaagtcctgcatttaggttcaccaaattgaacattaacacaaagaaaagacctaggagtatcttggtatttcacatgtgaatagtgttctgttgttcacagagcacttgaatctcatttaatcatttaggaagttggcttcagtgaatccaatttgttagattaaaaatttgctctgatttatccttttggttgctaatccactattgcttgaattaggtttaattaagtctgggtttatgtttattaccacatatggctgtattctaatccttgtcacatccaagagtgttgggagtgtgtacctttctcaggattacacagtgatgcctgggtgggactgggaagaagagtaagatttccttcttaaactcagagttctacctttgctttaatctctacctcccctataaaaaactttcctctcttcccagttacaattcatccgttttgttttcactatattcccctatacagaaaagtgtgtgtgcatgtgtgtatgtttgcatgggagtgtttactggcttaaactcagttatcctgcaccaaccaacttccccgcccataactcaactctagatcataaccccttacaagataagatccatgccttacacctcttaaaatcttcagtactctagcagagatttgcacatattaggtgctcaataaatattggcagaattgagtggttttaatggaatacaggcttcacagtcacacctgaattgaatcactgttaagctatttactaagctccatccattacttttccctctgattttgttttgtttttaatctttaaaatgggcataataaccacttcataggaattttctgagtattaaatgctatcataagttaaataaatattagttcccttcccttttgatttctagcctattaactctactgaggtcatgaggagagtttctttacatgaaatagtaaggttaaggtaccttaactctagccttccaaagttcctatacagagatcagatgtccatggcttctggtccccatcagcccacagttcctgcagactatcccagcccctgactactccctggagtcacagcaaggcagctcttctgatttaagtccaccatgcagggctatttgggaagcatgaggcctcttttctccaccatggcccttaacacatctcatctgcacagaacctgggctctcagacctcacaattattttcaattcaaaaaatgtttcactatttactttgttccaggaactgtgctagggccaaaaggtcaaaaagttgactaaggcatagcataattctaccttcaaggaactcagtctgctgacagtaagtacacgtatacaaactgatctcccacagagcagaatggaatagcagccaataaagagataagcccctggggaactccaaagtgggagatcaactctagatctgatcagaaaagcctctgcaggaatagtggtatttgagctgtgcttatggatgtatacagatagctgtgcaggtgaagaagactaaatggtggaaggaatagcctaagtaaaggcatagaggtagaaaagaatcagaggtattcaagtcacagccagcacaaaactttggccagaacctagggtataaacaatggagtagcagacaagaagcctaatacagtaggcagcttctgaaatgtctcccactgattgcctcctgatactcacaccctgttaccatactcgcctcccaatccaattaagttctaaaagactggactgacttccatcttggtctctccctctcctgtcattaactttgatggagccagctgccgtgttatgatctaccctatggaggtgcccaattggcaagaaactgagggcaccctccaaacaaaagccagtgaggaaccagggccctccatccaatgacccacagggagctgaatcctgccagtaacctctggctgagcttggaaacagatcccatcccggtcaaaccttgcattgactgtggccctaactaacaccctgattgcagtcttttgagaaccctaagctggaggacccagtcaagccatacccagattcctgtcacacaaaaactgttagagagtaaatgtgtactgttttaagccattacattttgattatgctgcaatagacaattagttaatatatgtggaaagaattagaggcaaatcttggagaatcctcagtaccagactgatatatctgacccatgactgatacatcttgtctgtacctgaaggcaattgtgagatattaaatgttgtgtgcaatgatgtgagtggagacaggttttttgaacagtcatctgtcagtggtgcataagatgagttggagcaaaaaagagagagattcccaagataagaaattaagcaaaactcttgagaagctcatgattccctgacaagaagcaaagaatacttgagcaatagtgacaatgggattggagggaagacaggagagatataaattagactcacctggtcttggctgtagatggaacatcagggggaaggagagacagaaaatcaaaggaagattccaaagaataaggcttaggaagctggaaatagggaaacatcatttacagactgaagatcacagaactaagggcaggtttcgagggaaagatgctgagctcaggttagcgctgttgagtttaaagtgccaatgaaacatctagataaattcaatattcaagactgaagcttaagccagaagtgtgggagtcacctacataaacttagaatctgaacctaatggggaccagggttacaagtcacagctcgagtgacgcagcaactaccttaacacacagcatgagaaggtgaggctgcagctcagggaccacagtgccacacttttcaccttgaaatcatggagaacacaacctggagaaatcactggcttattgccagtgatgccagggatcatgctgggaggacacagggctctacctattgattcagttaggccctgacaaaggtgtatatattttcttgcattaatataccaaatactgccccagggagtgatgtgaagccttcaggtctcattccagatgaatattcatactcatgtttgaaaaaagacattatctcataatctcctacaaacataaagtaaaattgtagttgccagggacttaggggaaggaaaaaaaagagtcatttaatgggtatagagtttccattttgcaagattaaaaacttctaaaattggttgtagaacactgtgaatctacttaatactaaaccacatttaaaaattgttaagatggtaaattataggttatggacattttaccaaaattttttcgataagaaattatttgtctaagagttcctggcacctcatcaacagaattctggtattgtcagagaaaataatttaaacagctaccatttactgactacctcctacatgccatgtggctataagttaatcttcataaaaatccaatgaaataggctattatcaaccttatggaggctaagaaatgtgcacaagatatacagccagtgagtagcaaagccaaaatttggaccaagatctctctgattccaataacgtgctacttcgtgtgctacactgccactggttgaaatgtagaaaacaagcttaaggtgtggaagacaacttcgaggtgggggtggatggaattaggagaatatcatatagtcttaggccaagaaccatgtcttattgttctttctaactcccacaaagcccagcacagtgcaatgtacagtaagaccttcaaaaaatattttggagaaataaatgaataagaaatcactattaaaaaaaacaaaatgacccatttccttcactcctaaaagttaaggtaattgctttctctggctttcaaaccagccaatcaaaggtaagtttattccaaatcaaaaggcccctgggtcttctgatcaacgatccaacatgtacagagttggaagtcagcactcccatccactcaacaacaaaaaagttgaacaaacaactcttcttagatccatcagagaaccaaaatcacaggacaaacagccgtcctgaaaactggagagacaatgaggcaaatacagagaattacagtttactggcgcaaaagaccacagctggagccaattccagaagaaacactgacactataatggatgaattgctgcaggtttagtgtgggctagcttgagagttaaacactgaggggtagcagctgtcttcgagggtccccaacactttcctgagttttaccttcaggacccccaccaggttcttattgtgaaaattgaagaaaaatcccctgatgctgccagcaaaggggtcggagatagacaaagtaaccatttaaaaatattcccagagagccctattctccttaagaaagctgccttcaaggaaaactattttaccagaacctaactgccttgggggaaggaaatacccagttccagccccttcaagccttccatgaccctattttagaaagagtctctagagaaacccaaagacaacagagaaaacaaaagcaaagacacgagagggaattttatcatctgacactacggttacagcaaacagtaaacacacctaactcccagccagaaaaacaaaacctcacaccaaaggccaatattcctctttcttttaaccagatgtgtagctttgtatggcagatgcacctgctggcaataacttaagcatatccccaagaatgcagactcacctgatctatataactgcatgctttccacaaatggtagtggttttcctgtcccagccctccaccactggtccaccctatatgtaagttccctcagtaaaccctatgtctcgttctctgactcggtctcttcttcagcctctcaaacctaatatagaactcaataggagtctggctgacaagctctcaacaaaaaaatacaagatatgccaaaaagcaaaaaaacacagtctagacaaaaaaaaaaaaaaagcatcagaaccaaaggctaatgtggcagaggttttggaaaagaccccttgaaggttcccagtggagtccatttctttgagaagagggttgttttttcccttctaactctatgatcctggacaagctttctaaagctggttctgctgattcttctacctcaaagtctgtcaaatcaatactatactttcttttattttattgttattatactttaagttttagggtacatatgcacaatgtgcaggttagttacatatgtatacatgtgccatgctagtgtgctgcacccattaactcgtcatttacattaggtatatctcctaatgctatccctcccctctaacctgaccccacaacaggccccggtgtgtgatgttccccttcctgtgtccttgtgttctcattgttcaattcccacctatgagtgagaacatgcggtgtttggttttttgtccttgcgatagtttactgagaatgatgatttccagtttcatccatgtccctacaaaggacatgaactcctcgttttttatggctgcatagtattccatggtgtatatgtgccacattttctttatccagtctatcattgttggacatttgggttggttccaagtctttgctattgtgaatagtgccacaataaacatacgtgtgcatgtgtcttcatagcagcatgatttatagttcttttggtaaatacccagtaatgggatggctgggtcaaatggcatttctagttctagatccctgaggaatcaccacactgacttccacaatggttgaactagtttacagtcccaccaacagtgtaaaagtgatcctatttctccacatcctctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatccttcacccactttttgatggggttgtttgtttttttcttttaaatttgtttgagttcattgtagattctggatattagccctttgtcagatgagtaggttgcgaaaattttctcccattttgtaggttgcctgttcactctgatggtagtttcttttgctgtgcagaagctctttagtataattagatcccatttgtcaattttggcttttgttgccattgcttttggtgttttagacatgaagtccttgcccatgcctatgtcctgaatggtaacgcctaggttttcttctagggttcttatggttttaggtctaacatgtaagtctttaatccatcttgaattaatttttgtataaggtgtaaggaagggatccattttcagctttctacatatggctagccagttttcccagcaccatttattaaatagggaatcctttccccattgcttgtttttgtcaggtttgtcaaagatcagatagttgtagatatgcggcgttatttctgaggactctgttctgttccattgatctatatcttggttttggtaccagtaccatgctgttttggttactgtagccttgttgtatagtttgaagtctggtagtgtgatgcctccagctttgttcttttggcttaggattgacttggcgatgcgagctcttttttggttccatatgaactttaaagtagttttttccaattctgtgaagaaagtcattggtagcttgatggggatggcattgaatctataaattaccttgggcagtatggccattttcatgatattgattcttcctacccatgagcatgaaatgttcttccatttctttgtatcctcttttatttcactgagcagtggtttgtagttcttcttgaagaggtccttcacatcccttgtaagttggattcctaggtattttattctctttgaagcaattgtgaatgggagttcactcatgatttgggtctctgtttgttattggtgtataagaatgcttgtgatttttgtacattgattttgtatcctgagactttgctgaagttgcttatcagctaaaggagattttgggctgagacaatggggttttctagatatacaatcatgtcatctgcaaaccgggacaatttgacttcctcttttcctaattgaataccctttatttccttctcctgcctaattgccctagccagaacttccaacactctgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagtttttagcatgaagagttgttgaattttgtcaaaggccttttctccatctattgagataatcatgtggtttttgtctttggttctgtttatatgctggattacatttattgatttgtgtatattgaaccagacttgcatcccaggaatgaagcccacttgatcatggtggataagcttttagatgtgctgctggattccgtttgccagtattttattgaggatttttacatcaatgttcatcaaggatattggtccaaaattctcttttttggttgtgtctctgcccggctttgttatcaggatgatgctggcctcataaaatgagttagagaggattccctctttttctattgattggaatagtttcagaaggaatggtaccagttaaatatagtgtggaggaacaaggaggaatccatactatattttcatcctgctgctgtcccctgaatctaggtccctgggccacttggattgttatgtaatctaactattctccctgcctccctgaccctataactaccccagactgattattctaaaacatcacttagcacatcgcagctccacctgtgagactcaatgtcaagggaatcaagggcaagctcttgagcctggcttcctgaaggagctttccacgctggtccacccattccactgcctcccggttccctcctctgccctgtcccagaagcctgccattaccatgcccagtgctgccttctccttctctgtttacccaagtgtgggttaccttccaagtacagttcagtccagctccatctcaataagagcctcagtgctctgtagccacgccttcctccataattctgtaacttttttctgtactattcatttaacctttatttttattcatgtagcctttattattaataacaccaaagaatggtgtaagctagtgtaaactatttattgatcacttatgtgccagatttttttacatatttatatactttacatagttattaatccttagtcattaaatcttactaaattcccatgcaataggaattataatcctcacttttcaaatgaggaaactgaggctcacagaggttatcctacttctccaaaatcataccagccaagaaggagtacagttggaaatcaaattcaggtctgtgaaattccagggtctctattctttttgtattatattatgtgacttctcattcacaccatcattattcattcaacaaatagtcctggtgtacctattatgtgccatgtgttgtaatatgtgttataacagagttaaagatgaattacaggccaggcgcagtgggtcacacctgtaatctcatcaactttgggaggccaaggtgggcggatcacaaggtcaggagttcaagaccaatatggtgaaaccccatctccactaaaaatacaaaaattagccaggcgtgatggcagccacttgtaatcccagctacttgggaggctgaagcagaagaatcatttcaacctggggagtggaggttgcagtgaactgagatcgcaccactgcactccagcgtgggtgacagagcgagaccgtctcaaaaaaaaaaaccaaaaaccaaaacaaaacaaaaaggtgaattagacacaaattcaggttacatagagctctgagatatgcttctttatgttgccatttctctttttatgtactttctgtctttccatgcctggtataaccatgtctgaacataatggatcttttccatcaggctataagtgactgaggtcaaggatgggaggttttccttaagcactgctatattgttagtatttaacacaatacctgtcacaaagtagtctgggaaaacacacacactgtttctccaccatctcacacacttctggcccaagatgtatgagttttttctacaattctccaactctctgaacaccagatggaagccctacaatttaattccattctgccctatctacctggagttaatgtcagatcctacaagttaaggactcattccaacaagactatctccccacttcagatgccaattgcaagtttgggcctctgatacttctgaccaaccagctataaatcagaggttcccacaaccttcttctcagttttaataatttgctagaatggctcacagaacttagggaaacactttacttatgtttactggtttgttataaaggatctaactcaggaacaaccagatggttgttcctctcagaggccaccaccctcctggcaccttcaggtgttgagcagcctggaagctcatcaaatcttgttctttaagagtttttatagagcttcttaatcttcagtcccctcccctctgccaagaagtcagtgggtgagactgaaagtaccaaccttctaatcattttgtccttctggtaagcagccccatcctgaggctatctaggggtccctaaccctaaatcacatcatcagcataaactccagtgggactgaaagggctccatatgcataacaaaggacattcctataattctggaacttccaagggatttaggagctctgtgccaggaataagggacaaaaaccaaatgtatttcttattataccacaggtaggtactcaagaaatatttgctgaacaagggaataaatgagtgaatgaatgaaagaatattaaaaagggatgaggatatgaaaagtgaggaaggtgagaaagagaacaaagttctccatttccatgtcccaagattcccaagggagcagtgcataaatatatagtagcagtttgagaacaggaaggaatttagtgccagtgttactgcttaggggatgggtgggagtcaaatctttcccttgttggagatctggcccacagggctgattggcagaccctgtacaatgtccccacttccacaccaggaagagaggacttcaggtccagggttcccaagttcaatagccttttcttttttgccttaaaaaaaattgctaaggcatgagatacttccgttctccattggcatctttgcactgtgcccagagaaacaatcatatcatgttcaggaaggccagggcctgcaatggtggggaaacaggaaccgtccccacagatgtcctccccccggggggaaaagagctaggggctggggaaaaaaaatactgtgtgaaaaggaaagccagacttccccagagcctccagggtgagggcctggcacttccagcatccagaacgaccctcagccataaagtccaggaacagcacattattcttaaacatacacacttttccttccatatccccatcctcctacacgcgtgtgcacacgtacacaaaacacacacaaacacacacccacacacaattcctggatgaaattggaccaggaggctttgtgctgctgagcatattccaactccttagcccagaggccaggccctcaccaggaaagtgtccatccccctctggaatacatctccatacccccagatccagcctgaccttcctgcccactgtccccaaacatatgttaagcccagtttagtccaatccattcttctcttccccttccacatactcccttccctcttcactgattagcaaggttttccccataggttctcaaccgagagcatctcagccagagctacctcctcttcctttcaaatttcaatagcacttcttgtccaagtcagtgcttcctcacctttttcagggattagaaaatgatcatatttgtacagcacataaagctgatgtcagccaggtccataagcccagagactcaagatgcctggaggacagaggggatcaatatccctgacacaccccacaatcccttcaaagtcaccgcacacacaagtgatggacaagctcaggtctacagacttcctgactctgctacagagcattctgcaagccagttggggaactagaaaagaggtatataggaaagtccttgcctttgaggagcttccatgctagtttaagaaatgaaatatacctgcatgtataagtaatatacacctgcacaatcatttttaaattatttgtataacagaatatggcctttggcatcaacaacatatggaggttcaaattccggccttgccactcacttgatgtgtgaacttaggcaagatagtatcacctctgtgatcctacttttcccacctttgaaatagggtaataaatatctaccctcataaggtcgtgtttttaaataacctttattgaggtataatttccacacagtaaagtttacccattaaaaggccccacacagtggctcgtgcctgtaatcccagcactttgggaggccgaggcaggaggattgcttgagcccaggagtttgcaaccagcctgggcgagatggcaaaacctcatatctaaaaaaaaaaatatatatatatatatatatatctatatatactagctgggtgtggtggcacatgcctgtagtcccagctactcaggagggtaaggctggaggatccattgagcctgggaggtcgaggttgcagtgagctgtgattgtgccactgccctccagcctggtgacagagcaagaccctgtctccaaaaaaaaaaaaaaaaaaaaaaaaaaaaagccatacaatttaataagttttcacaaaggtataggatcatatagtcattactataaccaagataagaacatttctatcacctcaaaaaattccttctagcctctttacagtcaatacccacccttgattccttgtcccctggcagccatggatctgatttctatcactataattttgccttttctaatttttcatataaatggagtcataaaatcatagtcctttgtgcctggcctctttaacttaggataatatgtttgaaattcatttatgttgttgtgtgtaccagtagtttgttcctttttgttgctgaatagtattccattgtatggatataccacaatttgtttacccattctcttgtttgtggacacttgatgagtaaagctgctgtgaagattcttgcacaactcattctacagacatgtttttatttctcttgggtaaatatataatagttaaattgcctggttatataataggtgtatgtgtgacattttaaaactttcaaagactattgccaagtggctgtaccatttgaaacttctaacaccaatgaatgtgagttcaagttgcttcacatccttgccaacatttggtgttgtcttgttaattttacccattatgatgggtatatagtgaaattttattgtagttttaatctttattttcctggtgactagtgatgttgaacacatttttatgtgcttattagtcattcatgtatcttcttttgtgaagtctctattcagatcttttgcccattatatttgttggattatctttctatgattgatatgtaaaagttctttatatatgtgaaaggaattctgtgtcaaatctatattttacaaatatttttttcctagactgtggctggctttttcattttaatggtgacatcttttgatgagcagaagttttggactttgataaatctagtttatcaacttttttttattattggttagtgtattttgtgacctctttaaaaaatattttccatcccaagatcacaaaaaaatattctctgaaggtttcttctagaagttttatagttttaaattttatgtttaggtctatgagccatgtcaaattaattttgtgtagtaatatggggtaagggtaaagtttcatatttttcatacatttattcaggtgtttcagcaccatatggggaaaggttttcgtttcctctactgatttgagttgttgatttgtcaaaaatcgattgatcatatatgtatatctctttctggactctatattctgttccattcatctatttttttctgtgtttacatcaatactacattgtcttaattactatagttttaaaatatttctttctttttttttttttttgagacggagtctgatgccaggcttgagtgcagtggcatgatctcggctcactgcaacctccgcctcccgagttcaagcgattctcctgcctcagcctcccgagtagctgagactacaggcgcatgccaccacgcctaactaatttttgtatttttagtagagatggggtttcaccatgttggccaggatggtctcaatctcttgacctcgtgatcttcccacctcggcctcccaaagtgctgggattacaggcatgagccaccatgcctggcctaaagtatttctttaatagataatgaaaattctccaaatttgtcctttttcaaaattgttttgactattaaagtcctttgcatgtccacatatattttagaatcaaaatgtcaatttacatttaaaaaatcttctaggattctgattgggattgcactgaatctacagatcaatttggagagaatgggcatcttagcaatactgattcttccaatccatgaacatgatatatctcttcatttgtttatatcttctttaatttctctccacaatgcttctcagcgcaagcattttgcattttattaaatttatttctaagtatttgatgtttttgatgctattgtaatgatactttttaattttattgttgaactttttgctgctggtatatagaaataagattgatttttgtatattgactttatatcccatgattttccaaatgtatttattctactagagacttcttttcagattccttagaatttttaacatacacatcatgccatctgaagatagttttatttcttctttttcaaacttcatactgcatttctttggcttgccatattgtattggttacagccttcaatataagtggtgagagaattttttctgatctcaaggaaaaagcatttgatattttactattaggtatgatattagctgcagaattttttcatagataccatttttcagattaaggaagttatatctgaaagcataagcattttaatcatgaatgagtattaaatcatttcaaatgttttctgcatttatcaagttgatcaaatggctttgcatctttatgttgcagatatggtaaattgtactaactgattttcagacactaaaccatccttgcattttttgggggagaaccccatttggtcttataatatcctcttttattttttaattatctcttttatatattgctcaattctgtgtgccaatattttagtaaggcttttgcatctatatccttgaaagatctttagttttattttattgtgaagtgttttttctggttttgtttcattcaattaaaaatattttttaatctctcttgtgatttcttctttgaaacatggattacttataaatgtttaatttccaaatatctggagatttttctagatattttattattattaatttctaatttaattgatttataatttaattctattgtagctagagaatatattatatataatattaaccttttaaaagtattaagagttattttatgactcagcgtatgattaattttggtgactgtttcctgggcacttaaaaagaatgtttattctgctgtataaggtagattgttctatgaatgtcaattaggtcaaattgttgattgtgctgctcagggctttttatccttactgattttttatctacttgctctataaattacttaaagaaagctatgttgttaaaatctctcactataattagatatttgtttatttttcctcttagttatgtcacgttttgcttctgttattagatacatttatatttaggattgttatgtcatcctgttgcactgatttacacttaggagtaaacagggactagaaatagactagccctcaaaaagaataaatctcagcttctgataaactcagtcattgattggattgagataatttgtcagcaccgattatctaaacctggatcacaaccacagctaccttcaatatacaccttcttttagcctagaattgggcagagttttgactatgaagtttaggctaatctggtgtgcagatatgccatgcaattccttcagttttcaaaatctagacttgctagtatgtcattagtattttattagctagcctgtatgctagacacccaggatttagtggtgccaaatgttgattccttgtattggtttatttatacattttgttgtctgactctttaagaagttcaggtcattgcttgagacaaattgtatttattcattaattcaacaaatactttttgagtatctaacagagtaaaactcctgcaatgacaatgcactagaatataagaccctgatattggcttccttcttccattcagccactattctcaaattagcagacagctttcttattatttgaggaaaaagagaaaatgtggaaagaagaagaggggcaggatggaaaaaataggggaaatggtggtaaatttgtctttggaagcagcgaagtggagggtaagtcccagcatccctaatgtttttctggacctatctacttgaattgggccaagtgggtaccactaaccaggagatgtttggaatcactgctctttccctggaaatcccaacaacaggacccagaagcatccccatcaatatttaggctagagcagacaactactatcaggagttgccaaaacatagccaggtggtaatgaatttagatgggagttccctgctggctagctgtgctggccagccccagttattttattaacctaattaatttgacccctcattctttatttattatgacttttggataatatttaatcaaagaacagcaaaattttattaatatgaattttaattaatatgccctcaaggaacttgcattttattggagaagccagccaggttaaccaataactaccatgcaatttaataaagtccataatagaggtatggaccaaatggtaccatcccaaccaaacaagaggatcattaactgtttttcttttttcatgtttttcaagagaccatagtgatcatcttcattgtaaacacgtttgagtgttgaacaggtcaagaatgatgggttttatatctttgtggcagcaacaaatgaatgtgttaaaacaaataatacaaatgaaacaaccaccatcccctcctgcagtatgattttctttcattgattctattcagtgttactgttattgtggttattatttcagtcattcttgagttaaagctagaaccacataaagtcgattcttaaactaaactaattaactcttaagcaggtataaacgtgaactccatttgactatgccaatagaaaaatagaccagttagtttaaggacactatgaaaatcattaaacttaaaactaacatggtgtggggcaggggagaacaatccctctgagaccagtgctttttaaatttccaagaatagaagaagtgataacaagaaaaatcatacagttggaagcttagcattttacaaggcagctagagaggacccagaggagaagcctatccaagattgatctctgtaatggttaattttatatgtcaacttgattgtgctaagggatgcccatttaactgataaaacattattttcaggtgtgtctattaggatgttgtagcaaaagattataatttaaatcaatatgctgagtaaagaagattcatttcccccagtatgggtgagcatcttctaatctattaaaggcccaaatagaacaaaaagcaggagaaagggtaaattctctctctcttcttgagctgggatacccatcttctcctgctctcagaaattggagctcctagttcgcaggcctacagacttcaggatttactccagtgccttccccaccaactccccatcccaccagctctcagctttgaaccaggagttacaccatcgattcccctggttctcaggccttcagacttgaactgaatcgcatcacaagctttcctggttctccagcttgcagatggcatattgtgggacttcttggcctccataatcacgtgagccaaatcccataacaaatctcttatatgcctatatatatatcagattggttctgtttctctggagaaccctcactaatacaatctcatgtggacaatacaagttaaaggaagacggaagaccaaaatccctgggcatgcatcttctcaatgtccttaccttgctctcactgcccagttctttcactgcctcttcttccaatctacttgaacagttaaccaaacagcagctaactggtctggtcagctggttgtgatcattccgaccctgggaatgattgcagtagggtctcaaaaatacaatgtacaggcaaaagtttacagcaggaagcatgaaaggaactggattacgtataaaccatgaaacatatctgccaggtcctcttccttaaaaaggatggatctaattatacaggggatcacaaagggggcagaatttgtaggaatgacccccccagagtttcacattaccaagactaagggaaaagttttagggagaactttggtgtctctaaacagaaataactccagcttggcaatgagatatgcgtctcttttctctacgatcttctgggtcttggtccctttcatgcactttcatatttgccagttatgtgtctcagtttcttttatccaagccctccatcaactgattatatttcatctctaattttaacaggcatgtgaaagtacaggatcttccacccccatctcagagcagacatcttatttcctagactttcatttcaaggccaacccaataaaagacattgaacttaaaatgttataaaatatgcttccactaatccccaatttaaagctcagttgtagactctttcctccccccaaccccatttctttagtaagagaaagtaagtaatgttaccaaactcttgaagtccagctgctgtctctaactctaaccaaaagacacgtaccatgtaatggaaaaaatgcaagttataaacttcaaatttgggcctggatataaatcttgattctaccacttcttagcattatgaccttgagcaagtgaataatatatttaactgcattcccaaatctgtaaaacaggaataaaagagttactttatagggctttaataatgatgaagtgaaatgatgtatataaaggtgccagccttataatgtacatttaataagttatgactattttaaaagggatcttcaagttttgtaataatgttggtgttcacatctgcatatgcctaactgttagcatagaactggtgaatgagaaatgcattgtgtcaattcctgaaagtatgagtgatggacagtagcagacctttctgctcataattttggtcaagaagttgtgctttcttatttttttgtgagatttccaaccaaaatagatgatgaactcataaatatgaactggtctctgtgctccagcaactgatagaagcatttctcaacctattcccacccactcctgggcctttcccactcaccaggtagaattttgagaaagaaattggcctccttcaagagagaaagttcaggcagaaacagcaccccaggcattacacaggagcaatcttgtgcccattcagagactaaccacaatccagatgaatccagacaaagccttagttagcacttcacagttttcaaagggctttcatatttctcacctcctgggcaaggccaactcttcattatacccatatttagcactctgtatatgtcttcattgtgatgacgatgatgacttttttttttttttttttttttttgagacagagtctcactctgttgcccaggctggagtgcaatggcacgatcttggctcactgcaacctctgcctcctgggttcaagtgattctcctgcctcagcctcccacgtagctgggattacattcactggccgtcatgcctggctaatttttgtattttgtagagaaggggtttcaccatgtcggccaaggtggtcttgaactcctgacctcaggtgatctgcccacctcagcctcccaaagtgctgggattacaggcatgagccaccacgcctggcccattgtgatgattattaattagatgataatgattgctcacgtgtattatttcttcagtgtctatctccaggaggacaaggaccatgtctaactagttcagcattgtatttccagctcctagcccagtgcctggcacgtagtaggtactcaataaatatttgttgaatgaaaagaagctgtagcattcatatgcccatcactctctaatgaaatatttacaattgagctaacaggtctagttcaaaaatttatctactgccaaaacaaatatcatgacatttttcagagtcaaaagcaaatctctttttggctaatccaggttactacttcatagataatcagaaaaggactacagacacccctaaccctcactgctaatgaatcatcttcccatttaagaagttagcggactattttctttccagtttcatgtcatcagttttacttaaacagttgtcaaccctaatgggttgtttctccaaattaattcttcttgcttttttaggaagatttatagcacatcaccctcattctgatctttttattgtccaagattctcctcctataagataaccatatgatttagagactggcttaaatggcccaggacctagaattcataatatatatttttcaaattttaggaaaatttcagatttttcctgactactctctcctgattcctacccacaatgatttcttttttcttttcttaaaattttcttgttggagactctaaaaataaataatcagagaggtgctgtattcctggtgttaccccagattcactgcagctgtgacgaaggctgccaacaccgtctaatgacacattaaatacactgtctatgacttgtcctgtcaggcagagccaaaagctactttgattaatttttatttttaaatgcaactgccatgtggatatagatcctgcttttgtgacctttgggcagggcacgtaatctgtctctttcacctactcttctacctgcaaaattggtttgacaataaaatctttctttctaaactgatatgtagtaaaagataaactatacaggagcactagtgaaaagatgccatgcaagtgcctcaaagtgatctgttttctggactctctgtggcacatcttgcatctctaaccagtctccctcagccatgttctaagccccagccccagcattaaccagttgtacaagtaacaaatacagattcaccttactgcaaactaagtcaaataagaaaataattctcctgctaactaaaacacgcatcttagtattctagagcaaaatgcaggtaacttttggataatccaaaccacagctttataggcagtgatgaccagccttctttgagtactcagcatatgccaagaactgttttcagtgcactgcatacattatctattcagtcctaagtaccctgtgacatagctgtgattattaaacttcatttttagccaggcatggtggctcatgcctataatccccgtgctttgggaggctggggtgggaggatcacttgaggccaggagcctgagaccaacctgggcaacacagccagaccttgtctctacagattttttttttctaattagctgggcatggtggcacatgcctgtagtcctagctactcagaaggctgaagcaggaggatcacctgagcccaggacttcaaggttacagtgagctatgattgtgccactgcactccagcctggataacaggagagaggccctgtctcaaataaataaattgcattttacatctgagaagactgaggcatatagaaatcaaatggttttcctgagctcacactgacggtaagtggtagagctcagatttgagtcagctggcttagcctttatactccactgcatttcaagataatgataacaaccatttatgtgccagcaattgggccgagtactttaacatagattatctcattaagttctcataataatcatctccatctacagatgataaaaatgagatttaaaagggttaatttgccaactatcacagagctagtaagtgatagattctgagccagaattatagaattatagccagattatagagactgacaacaaaaatactaaaccatgttgtgaaagccagtgatggctctacctacagtcttccatggaagactccctcatcgtttacaaggacaagaaaatgtgtttgctggacctagtggggagagaaattcctctgcactctccactctaatgggtttacaggtaggccaagggcaaaatgaactcctgagtaggagcctggagtctttgttgatgcaagctgtaccagtggatttcaattagccaggaggcttttggagtgcaagcccaggccatggacaactcacaagagagaaggtcccaaaagctccccaattctgcccctagcaacagaggcttcctgtagccaagtctgtctctgatttgcaggtgggtgagttaaattcacacaatctcagccataactcttagaatgggttctccattgccctaaccagaaaggccccagaatgtttgtctccagtgatcaaggcctgccatctgctgaagttttgccctttgctttgtcatcacatgaacctaatgctctacaatttactctgccctttatcatcaaatattgcccctggtacaatcagggatacagtagaattgtgcaggaccaaaggaaataaggacaggtctgagagaagggaggggatagagcaaagaatcttgaaaccctcgggttggtgattctggatttgtggtgctgtgggagacagggcaaatatttccgtgataaaagggacttctgaataggaagaaaagtaagaggagaaaaagagggataccctctggggcatccagtgccaccagtataatgatcactaaacagggtgaaagggaaggcaccaggaaaccggcccagagagtgtggttatacagtaaaattaaagccaaggttgtccccctttgcatttcctgtcctcccagcccctcccatttagaccatatccatcttttcccgtgtggaaaaaaagagttcacttgactctcctttgcagacttggagtaagcctcttttctttgccctcaggctctgaaggcgtctactacagtgcgtggagcaaaagagagacggcatcgccccctcgtggcgcagggccaagctctgcggtattccggacgctgtcctgggctgcccagacaggggcaccccgtgggagtggaaatgctgccctcagaacctctggctgttgaatgacttgtgtcttgtcagaatggtgagatccccgaatgccatcaccctgttccttctaccctccccattgatgttcacacaggtcagctaagctagacctgtctgcagtgtgttttgaaaacaggttgcccctgcaagaaaactcctggtttagtaaatcagcacatcagggctagagaagaaaagagttgtgctgtctttgtttccatttcagtccattctgccaagttgaagcagaatgattttcattcatcttaaatccccccaaaatattttttttaaataaacctctcaaaccaaacaccatcacatatgtaccctaaggaatactaagtcacctcttcaggcaacggaaagaaaggaccagagaattgctgtcaagcctagggtgggtggaggaggcagggaattaattttgttgagtggataaaggtctgggcctcaatcccaaaagcccagattggggcatcgagcctacagcacccctgtcagtcactccctgctgtccctggagcctgggcaggcaaacagtcatccttctgcactgtctctctgggacagccggaacctttgcccccatcccgaggtcaccctctcccagaacctcctctgcctctggtaagaggaggtaaaaggaagggggacacaggaggtccatcagagcatggatgaagctgcccctacatcagagtgcagagcttggagtctagccccatcctggccaacacagaagcagggagtgagagaggcaaaaacgaggagccagcctgtttccatagatacagatttcagttgcattttatgacagccgtgccaggctgcctggagaggcattgtttggatgtctagggacccgctcagaaggaaaatgaagtaagaagcgatttttttaagattcaagtggtttcccctcccagtttcagattgagatccacctccgccctctggccttctggcagaggtcatccctggtaggacacttgcctttagtacagcctgggcagatttaggccctccaaccccaggcctcgaagatcacagtcaaaatgattcttagaagcaagcctgctgtccctggagcctgggcagtcaaacagccatccttctgcactgtctctctgggacagccggagcctttgcccccatcccgaggtcctcctctcccaacactgctagtgcttctctaacagctgctctgtggctgaaggagttccaatttcccagcccctggtgacctcttgtgagggctgccactgaggctttgagagaagaaggctcacctggtctcctgccgggggctcagcctgcagctggggaaggactccccttacttctagattcaaaacactcattttcctttgccactcctacatcttcgtctcctacatcttcatctcctacctcctcatctaggtggtgcccttctctctactcatcactcattcatttctcaaaacccattgagttctttcattcgccaggcctttataaaatagacgtaagagactttccctgtactcagaaatctcacagactagtgggggatgcagacacataagtgaactactagaaaacaacttagatagggtcaagtaagaagtcctggggaagttaaagcccaaactgagccccaacggatgagtcagttaggggagaggagattcaaaatagagaggggactgcgtaggcaaaggcatagaggcaagaaacaggattatgtgcgtaagaaactcggtagatcataggtgctgagagccagtgcaaagctatgagtggcaagagatgggctggagtaaattggcagtcgtcagacagcagagggccctatgtgccatgctaaaggccccaagcttcctcctgcagtggttcttcagccatggctcacggagttccagggctccactgtggtgcctcaggggcaggactaggggcctctcactctcaacctgagtgatttttttttttttccagacagagtttcactctaactcaagtgatccgcccgcctcagccaaagtgctaggattataggcatgagccaccgcacccagccctgagtgacttattttatatgtacttgaataggtgacagcaaaccacagtgagattaaagtctgggaaggacacgataaaagaggcatgtatgggaaggacatgatcaaacgacgtttcaaagagaccactccagtttctaggcctcacttccaaccattcctcagggaagtctactgcccaagaaaatctctgatggtaatacatgatttacagcaaaaatgaagacttcttcagtacatctgtgataattatttccaaacttcatcctgagaaaagaaaacgaagtgggatccctttcccttagacttcagagctgttttcaccagctggctgtgctgatcgtgccatctagtggtaggagtgcagcatgactccaaaaggaaacaagcttgcatttctttctgaatatctgtattatcttatttaatcctcaaaaaaccttggcaaagtatgtctcattaatatacccatgttacaggccataaaactgagagatgggaagaaaacaatatttgttttgagtctcctgtgggttaggaactatgtcagctgatgtacatgagatgcattatccccacttacaagacagacaaactgaagaccttggtgactgagagaccaactagattaagctacagacactgaggttttcctgcttccaggtctagattcattccaaaaaatctggtcagattcaaatctctaacttgagttgaaaagaaaccaagtagtaaagaatgaggaaagaggcaagcctttgtgaaattcagagtaactggcacagacagaccacagctatttctttgtcatgaatggcaaccaaagcacagttgtatattagattctagaataattataggaagaataattaccaccggaatatgcaaattataggaatctgtgagcctaaagccaatcagatgcccagcaagtacgtttcttaagagtgagtggctgctttctgtagaacagagcatcgcttggagccaggaaaaactgagaattgtggtttgaatggaaccttaattccacatctgaaaccttaattcctctttgccatgtaatatagcatattcccaggttccagggattacgacgctgacatctttgcgggccattattctgtctttcacatacattgagaccaaaaagaccaagtacctataagaggaccaacccagacgggctgtgacaattacgctgttgcttctgagtgagaagttacaggcccaagaaagggtaatgacagccttagagatacataaaagagacaagcaatttccaaaacaaaaagcaaaggcaaaaagaaaaataaaaaagctctctctccataaaaaggtagaaaatatgcctataaaggagaaaaacagggctggatgtggtggctcacgactgtaatcccagcactttgggaggctgaggtgggcagatgacctgaggtcacgagtttgagaccaacccagccaatatggtaaaaccccatctctactaaaaatacaaaaattagctgggtatggtgacacacacctgtaattccagctactcaggagactgaggaacaagaattgcttgaatccaggaggttgcagagagccgagattgcatgactgcactccagcctgggtgacaagtgagactctgtctcaaaaaaaaaaaaagttaaaattaaaaaaataaaataaaaataacattcttgctctttctcacctatctcatccatcagtgatatctgaatatagtacaaatcaggcatccagagccataaaatgcaagacaaaaacacattggaaaagcgaaatgtcacagataatccccaggtttgactttctgatttgcgaatcagaagaggcccttgcaaatgatgataaaatctgtctccagatgcaccaagatgatgaattatatatatgtatatatagttgacccttgcacaaaatggatttaaactgtgcgggtccacttatacacaggtgttcttcaataaatgcagtctgccttccgtattgtctccatattggtgggttctgcatcagcaaccaaacatgggtaggaaggcaagatttggaaatctgcattatagtagggctcacttttcatatccacgggtttcatagggcagactacaggacttgagtttgtatagattttggtatctgcgggtggtcctggagccaatcccccacagatactttgggatgactgtactcctttattatcattatgtttaatgccagcagagaaagaggactaaaaactaggaggagaatcagcagtactgacattgctatcataatccagttttttaagcatccaggcttaaatgctgaactgaaacagaagctgatctggcaaaatttttttctaactggtttcttgaatttaagtgaaatgtagagggctttctaagccaggcacaaagtcaagaaacaatacatttttaaatgacagacttgattagataaaaatataaattctctgtacagcaaaacacactaaaagtaaacttgcaagacaagtgatgatttggaaaaagttttacaacataagtggcagaggaataataaccatagtctataagaagagcttatacgtctataaggaaaagacaactgctccccctacccaaatggacaaaggatatgagtaggcaattcagaaaaaagaaaggcaaatagctagtaaacatgaggagtcacgccatctctctagtaaccagaaaaacacaaactaaaataagatactttctgcccatcccattgtaaaaaatgtgaagctggacaatagccagtgattgtaagaatacataacgaagtgctcccttgacagctatatgagtgtagtatggtacagtgtgtttgagagcgattggtagtacctatgaacttttaaattttacctcttttgaacaatcatttctacctctacacactcctgaaatattcctacatgtgctcaaaatatattcataaggatgttactacttaaaaatattgtgacaggaaaaaaagcaatctaagtgtctttcaatagagaacagaccaaataaacgtacaggatgtccttactgtggaatactattacagacattaaaaggatgaggttgatctgcatgcactgcaaagatcaccaagatatattaagggaaaaaggcaagtcacacaataatatgcaattcgttgatctcattgacatgtacatacatatatgcatagaaaaagcatctagaaagacacatatcaaactgttaagcatggtcacagtgatggtaggataggaacaagagggtaaggagaggcctccactctttttatttttatggtttttttggagacggagtctctctctgtcacccaggctggagtgcactggcacgaactcggctcactgcaacctccgcttcccaggttcaagcaattctcctgtgtcagcctcccaagtagctgagattacaggtggctgccaccatgcccggctagtttttgtatttttagtagagatggggtttcactgtgttgtccaggctggtctcgaactcctgacctcaggtgatctgcctgcctcggcctcccaaagtgctgggattacaggtgtgagccaccatgcctggccgaggcctttactttttaccctacatgcccctatattgttagttttttttcaatgtgcagatattcatgccatacatttgtagttttattaaatatatagatatgtgcaaagtgaattagtctatttagaagatatttgcagctatattggttttacagaacaaaaagcagctttttaaaacatgctaaatgttaactaattagcacaaagaccggagacccgagatgctctgaaaattcagcactgtagaaccaaaccttataattaaaggagacaacatgggtaggccagagcaaacatggtctctggagtcaagcagatctggtcctagtcctggccctgcccctttctttctgcaactgtgtgctaattacttaagctcactgcgtctccataaaataaagatacaagtgcctacccctcagtcttgatgaaaacaccatgtgtatacaaaatatttttctccctttctcatttatgatattgtatatgtaggctgggctcatatggcagctgggagactgtagtgaacattttacaatgattttttttttaggtggacccagagaaatgtttttagggccctatcttggtggtagagtgtcaagaggtgcagtttgttgttggggagggttgtgatacaaaagctttgagcaccagggccaggatgaacaattctagtagctgcagcttcctagatcagtggttctaaaattttagcatgcattagaatcacctgggggggcttgttaacccagcttgctggtcttgccctcagagtttctgattcagcagatctggggtagggcttgggagtacacactgtcctaacaggttcccaggtgatgccgatcctgctggtgtggggagcacgctttgagaccctcagacttaaagcatcaacaactgcccctagccagtgaattttaggctgcagcagactctttccctacccctagttctggagatgcttcctctggcgttctctctgaaccttcccaggcatcaagaattccaggacactccctggttttacccatggccagtggccaatttctgcagcctgtgctaattctgtccaaggtgatgcggcagctgaaagaacccaagacttttagttaagggaggggagaaactcgggggaatgcggagagccagacccagcccctggcctgggtcctgcctgctctgtgtgctcagcacaaggacaggaattgtatcccccttctgcctaagcagattgggaaagataactatgttagcaggagaagcctgggccgaggggtcgtgctctatagaattggcacaatctgctctcatgcatgagctgctcctatcaatagagagacctgccttaccctgacaactcgtctgtgctggaaatcctctctcaagtgaaagtccccccagttcccccctccaacacaccctttgcccctcagggcacgggagcccttgaacctcagccaaatggttgtgatgaagaatttctggctcccaaccaaattggccagggaggagggaaagagagggccatggcctgcctcctgaccctctccaggtggcacaaacagaccaaaaaagcaagtattgatctctctgctggtgaagcaaagtacccttggtttctctctctggtgaccctcttcctaataatggtgatagcaattactatctgtcaagcgcttactatgcaaagtattggactcagtttcacacacactgttttattaaatcactgcaactctttgaggcagacactgttcaccatttttcacaagagaaaactgaggctgaaaccaggaaagtcacttaggcaaggtcaggcagctggctagttagtggtgaagctgagacaatctaaccccagagtctggcgttaacctcttcactgttcagtttcccacaagatggaggctcccaggccaaggttaggcccaggattcagcatgatggggtagaccagattctcccccgacccctctctttgagcaacgtacatgaggcctctttgcacactccatgtgctaagcatcacataggggaccatgcttcgtttacctttgtgctcccagcacagtgccaagcacacagtagctgcttagcaaagcctgtggtagaaaggaaggataaagctgtacgatgggcactgggtagtaactggcttcttgctggtgttggggttttgaagacatgcaggtgaacaaacaatacatagatgaacaaccaacagattaaaattacatttcccaattatgtttgtccttgcccactctaccacagcccctctggcttccttgctgcctcaagcttcgcccccatgccctcacgattctctcaccttcttgaaaaattgctcaaatctcacctcagtgaggtctctttgggcaccacctcccctccaccagcaatcccaatccccctcaccctgccatatgttctcatttctggtacttactaccttcaaatgttctgtataattcactcattcattgtgtttaatgcctattctccacctccccactaggaatctttgtcttaccaaagtgtcccacacaccttaaagggtgggagctcaacaactacttattgaatgaatctctaaacattgcccactaagtcagagctgggcttgaaatactcagagaagtgaccggattctcccacagccccccgtcctatgtttctcagagactcgttccccctggcacttcccagtaactggaagagagattctacatctcccaattccagtcaccagagggattgactgaggatggtcctcttgggccccataaatctttctgcccttctcctcaggccagggctcacttggttctccctaaagagactctctgcatattgagtctgtgtcccataactggaggcacccggagccatggaaaacacatgggcttgagagctatgccacaaccttagggtgtcatttcaactctagccttggtttcctcatctataaaataagggctgggaccaatgatctcctccagtctttcccagttctgacattttccctgtggaagtgggggagtgcgtaaccttggtcaaaacgtacttagaaacaaaccaacccatggccctggggcacaggacatagccacactcagatcatagcaaatataaccaacaagtgaacaggcattcacagcatcacataggttagattagcagccaccatctgttttcacaaagcaaaaaaggcagtgattattatctctatttcacagatgagaaaactgaggctcagaaaggctaaacaagccacccacacacaggaagcagaagagccacactcaaagccaggtcttccaatggcaaattccacagactttccacaaagaactgcctcattgcttttgaaatgcaccctgggccaggtgcagtggctcatgcccgtagtcccagcactttgggaggctgaggcaggcagattgcttgagctcaggagctcgagaccagcctgggcaatacggcaaaaccccatctctacaaaaaatacaaaaattagctgggtgtggtggcctgcgcctgtagtaccagctacttggggggctgaggtgggaggattgcttgagcccagaggtggaggttgcagtgtgccaatatcaggccactgcactccagcctgggtgacaaagcaagaccttgtctcaaaatagaaaagaaagaaaaagagagagagagaaagaaaggaaagaaagaaaggaagagagagagaaagaaagagaaagaaagaaagaaagaaagagaaagaaagaaagaaagaaagaaagaaagaaagaaagaaagaaagaaagaaagaaaggaaaaacgaaccctggtaggagaatgccaccattagattatccaaaatgtcaataatctaataatctataagattacagaatataaaattggaacttacatttgaatgtggttatgtctcctattctagacatttacttatttatctcaaataatgcaatacagacaccctgggaagacatccctctgaaagacctgagaaagtgattcttggtaggaatagacaagtcatctctcaatggtagctaaggtgagcctctttcccgatctctttcaaaactttccccaagatatacacgactgagtgtttatattttcaaggacttcccagctacaaacagaagaaccaataacaaagataacttaatcaattgggtactacgagtagaggagtatcttctttgttaacagcgtaagaaaacaaagaaagtgctaaattgaaaagctagatttgtctaaatccgagagactataactggttcagagccttgttgacagccccgtttttctggattcaaatgcatcctctactaccatctctcacaaaatgatgatgagcgatgacaccacccactacattagccaagttggactgggaagccttggatagggagaacttcattttaaagagaagctttgtagattcttttctcttcataggactatatcagggagagcgcaagcttcaggaatcagcatgtactgaatattcccaaagaaagaatgattggattttttcccctcatcctctgacttcttaccttattgatattgcagggatcagccttgaccatctatttttaactgaaggatttgctatagggcattgtcccagtcagtgtgggccctcaaacttgggagttcaaaagaaatcagacatctaaagtaaacaaggttttgggctagtgaccattttatttaaaatggaattggggactcacacaacattggtaccatcctccttcaaactgcccccatcaaaatgcaatatgtccatgacaccagaaaggacaggaagggggggtggggtggtgaagccagtgcttagattttttttgtctagtttgccctccaagttgtcttcaatttagtaatcatacattgcagatttcataaaacaatctaagtttcaactatttttgctccattgttttcacgaataaacttgtaggataaaatgcccctatttttggtttggaaatgtagtcaaaataaccattttttatactaccaatagtcagtcccagatgatgggacgggagtgggcctcagagagcatatgtccatgccctccaagcatcattcctcattaagccacattagaatttaatccaagagcctcctggtgagcaaaaccatcatatccccatttaacagatgaaggcactaaagtctaaaaatgttagctgacattgattgaacttccgctactcaaaagtatatgtaattataagtgaaacgtggtgagaaaggctattactttgacaaatggcaccagaattctttggagtgttaaggctcctttcaaagagggagaccaccctgctgaaggtttgtttgtgtttcttttttattgttttgatctttttagaaagctctttccttttatgtttagttgacacataataattgtacgtatttgtgatacacagtgatatttcaatacatgtatacaatgtgtaatgatcaaatcaggataattagcatattcagcatctcaaacatttatcatttctttctgttgggaacaatcaaaatcctctcctctagctttttgagactatacaataaaatagttaacggccaggcatggtcgctcatgcttgtaatcccagcatttggggaggccaaggcgggcagatcgcctgaggtcaggagtctgaggccagcctggccaacatggtgaaaccccgtctctactaaaaatagaaaaaaaaaaattagctgggcgtggttgtgggtgtctgttatcccagctactcaggaggctgaggcaggagaataacttgaacctgagaggcagaggttgcagtgagctaagatcgtgacattgcactccagcctgggtggcagagcgagactctgtctcacacacacacaaaaatataaaaattaaaataattaattaattaatgttaaccatattcaccctacagcactgcagaccaccagaacccattccccctatctagctgtgcttttgtatctattagcaacatgctccccatccttccttccgccactacacttcccagcctctaatatccacaattctgctgaaggctttgagagacaagagcaaaccaccaataaaaaatgaaatatggtcctttggaaaggaccaaccactcttggtgtgactcagggcagagggattcacacaactgaccacttactgtccctacatcattaagattctcccagctgatgataaggccttgggaaaatgcccctaggctcatgcgctctggagagacgccaaaggtttactgatgtacaggcccagtctgctgctaaaagaaactttgggaggcacagaagccccagctaagctttcacacatcagctttccccatcctcctcccctcagtgcccaacacagctctcccattctctcactcccattgtttcccaaacatccctcccttcataaaagctgtctggctgggagcttaaaatattgctggacagtaaaacctacccatcagggccaatccagtcatatctgctcagtcgtgcagcacagtaggggcggggtagagaagtgggaggtgggcttttaggcagcaaaggaaagagacgaaagttgccattttgctgctgagcgccaagagagaaagagcacatatttctccgtgggacactccttgtattggcaagttttccttgggtgatattagtttgtaaccttccccccaattgttctttctcagcctaatctaagggccatatataggcttctccaaaaggaaaaaggttgccaataagattcagtcttgggctgggatggctagacttacactccaactctgaaaaccctcttcaagttgacctaagaactggcagaggtttggaagggagaggaatgctggaataatcagcaggatggggaaacagagatgtccaaactcaaactacaatttgacttcttaagctcttttcatgtctacaggaatccacagggacctaaaccaagtatttgatatttatgaaaaagttttgtgcccttttcactcaaattctacaatagaaataatagtcataattactgaatgctgtgggggtagcggaggcttcgtgctcagcattttccatgttggagcatttaatggagcacaggaagggatctggctaaggaccataaaattcctcctaggagcaggttctgttgtctatctatgagaactgctggctagtggctgttctagaaactagaaaagaggcactttccacctggttaccaaccagagtggtaagtggccattgaacactttggataacttattaatggatgtatatgtgttattctgcctcttcaaaaccagaggagggctatgctgtaatgggcttagatctagaagaccagggctcacatcctagctctgccctcactagctaagcccccatcttggagactcatttcacctcccagcctgtctttttgtctggtaatggggattgataatgccaagttcactggttctcagacatccatctggggatctgtcagttctagctcaagatgaaggtttccacaacctgtgaccaaaatgtgacaatgataaagttaacaatgtagtaaatgtttcaccaagttaagtgtgttcaatttaaaggcttgtcttttattctgaagttatgtcctctctagttttgtggtgttaaaatccccttttatgaaatgatgatgaaaatagactgtagttgtagttagtaatttaataactcttttttttttttttttgagacagagtctcgctgtgttgcccaggctggagtgcagtggtgtgatctcagctcactgcagcctccacctcctgggctcaagcaattctcctgcctcagcctcccaagtagctgggattacaggtgccccaccaccgtgcccagctaatttttgtatttttagtagagatagggtttcaccctgttggccaggctgatcttgaactcctgacctcaagtgatcctcccacctcggcctcccatagtgctgggattacaggcatgagtcaccacgcccagccaataactcttatttttatgtccttgtttggcaaaataaggagttggtatccttatgttggtcacactagtttgttattattatactagtctgtgaaatctaagtctgagaaccactggcctagttcacagcttgttatgaggactgaaataagatacgtgaaaatgtatcacttagatcaaggatacccaaacataaggtgttattttaatcattacctctagccatcattttctggtgggatgttcctggccatatatggacaccctggggttggaggcttgaactctatccatttattttctatctgtaataggtctgttcactaaattttcacaagcaaaataaaacagagaattatctctgagaaagagaagagaaatagtcttcctttggttcagatttctccctgctcccacagaacgctttgcttctctgatctgacttcctttaaattttcactgttagaagtcaggaaaccaatacatttcccttcgcagctctaaagtgtctctccttaacagcacagtaggcctgtttcaacatcatggggttggaaagattgtgtcctaaattacagtttctctccttcagttatcacaagaaactgtaactagacatttaaaaaaaaatacaatcttagcatggcggcttagagtatagaaagacatgggcttgtttggctttggtttcaaaattactaatgagtggtcaggaacgacttcttgtgtcatgaacatgtatcatgacactcttgtcaagaattgttggccttccagtttatatatttgatctcatacaaaataagcagttttgtgtctcagagcagctggttggggatcaatttactatcctttttgttatttaccattttttacaagttcttaatttttctgctgttagctgtagcaagaggactgaagttccttggtctctagtattcatattacaggaatttggggattgagaatttcagatttcacaaggattactattagaaccatgcactgctgtctatggagctcccactctgtgaagggctttgttctgtgttgtgatggttcacaaaagatgaggccaaaatggttcctgccctccaaaaccttttgatactaaaggggggaaaacaagattggttaacatacaggactgagagcatgtgctcatcacacacattcatgtgggtatgtgagtgaaatacactgtcaaaaatgaactgatatatcaatgagggtaagtattagcaagatagttaagattcagtaagatattagtaagatagtaagatattagctaaatcttatagaagtacagttattcaaattgctgttttaacataaattttagaatgaactatttgataagaaatgaactttttcctggctctgccaccagtgagctttatgcttgggctgcttacctgattgtgatgtttcccacctattttccaaaaggcaatgggaatggctaccactcttaccagggcaattactagacttaactatagtctgaagagttaaaaatagatacatgtggctgggattgagttgctgtttccgattccgagctgctggttccttccccctctccattacccatttctccaaggaactcttcccaatgccagacccatgactggggatgccacagctgctgtcactttttcaggagaagagaagctgctgcaggatgccctgcctgattgggagcttatgaggcctcaagaggaggagcactctctgctctcccacaagaagcgaacagctattgtgcctgccctgacagcacaggctggacattgcagatgcctgcaattagtatcctgccaccaggttctgtctggccagactccaaatcacaggttggaaataggcttttgtgtttaacaaatatcactgtgattaaaaaacaataggcatatccctttagccccataggttcctaggcctatagcatggggcatggctagaagaagcccagagcaagatcctctaacatgggctcttgccctggtctgagggcagtgatgagtaaacttataactctagagatgttcaagctgcaggaacaactgttctccattgaggtggaagttttgctcatcattctttataggttacaggtttgcactggatgaatgacccagttgcagccagccccttgtcagctcaatgccatttccattagccattgctgtgctacaggcattatatactatcatgtttaacgatattttttctatagaccaaatttttgactctattaaaacagccatatgttacagaccctgaaacattttcattccataggacactaaaagtgtcctagaagaccttcctcatcctgtgacatgattccttcccaaagcattctctctgttctttggatttaaaagagtaataataaaaatatacggccctcaatgtgtaaagctattaataagggtttccagatttcaacctagagaagaggaaacataaattaagagcacagaagtcaaagaattgtgtagctttgattgcaggcagtttatctcaatggtgtagtgggaagaacccagcctttgtgatcaagcaaacagaactgctgctatttagctgtctaatcttggacaatatatttagcctctctgagcctcagatttcttttttcttttttttctttttcctttgagacagggtctttctctgttgcccaggatggagtatagtggcacatatcagggttcactgcaacctcgacctcccaggctcaagcaatcttcctggctcagcctcccaagtagctgggaacacaggcatgcaccaccgagcccagctagtttttaaagttttttgtagagatggggtctcactgtgttgcccaggctagtctctatctcctgggctcaagtgattctcttgccctggcctcccaaagttctaggattacaggcatgagccactgtgcctggccttcagttttcttatttgttggaatcaacttagttaacaaatacttatcaagttatcactgtgtgctgggctgtatgtcaggcattgagtatatagctgtaaataagacaggcatggctcctaccgtcatggaaattacagtctagcaggatcaagttaaatgaaataatataatgtcaaagttctttcacaaagttggtattcaataaatgctaatccccttccacttcccttcaaatatacgatcattatatattctgacactcaaacataagatggccacagacaatttcatacatacaagaattgtgttgggagcccagacacccatagtataagggaactcttcagcattatgtctcacgaaacttagatcagtgtgtggtcttgatttaaatccatgtaaccaagggtttctatttatggtcaacaatgaatccttatttttggtggactttaaggaattatacaaatattgcctcattgatgctttcagaccatttgtgaagtgaatgagaataggtattattattattaaacccattttacagatgaggaagcggatggaagcacattcttcggggccttctttgttctctagtcctagtctgcacaaaggaagcactggatagacgctgtgtgcacattgaccgttctggcaacttggaaaggagaggtaccccgcgttagcaaaaacagatattgactcagggttgcattgcggccgctcagctcttgccttctccctcatttcttcaggtgggtgagaaatgggcgactggagtttcctggggaacatcttggaggaggtgaatgagcactccaccgtcatcggcagagtctggctcaccgtgcttttcatcttccggatcctcatccttggcacggccgcagagttcgtgtggggggatgagcaatccgacttcgtgtgcaacacccagcagcctggctgcgagaacgtctgctacgacgaggcctttcccatctcccacattcgcctctgggtgctgcagatcatcttcgtctccaccccgtccctgatgtacgtggggcacgcggtgcactacgtccgcatggaggagaagcgcaaaagccgcgaggcggaggagctgggccagcaggcggggactaacggcggcccggaccagggcagcgtcaagaagagcagcggcagcaaaggcactaagaagttccggctggaggggaccctgctgaggacctacatctgccacatcatcttcaagaccctctttgaagtgggcttcatcgtgggccactacttcctgtacgggttccggatcctgcctctgtaccgctgcagccggtggccctgccccaatgtggtggactgcttcgtgtcccggcccacggagaaaaccatcttcatcctgttcatgttgtctgtggcctctgtgtccctattcctcaacgtgatggagttgggccacctgggcctgaaggggatccggtctgccttgaagaggcctgtagagcagcccctgggggagattcctgagaaatccctccactccattgctgtctcctccatccagaaagccaagggctatcagctcctagaagaagagaaaatcgtttcccactatttccccttgaccgaggttgggatggtggagaccagcccactgcctgccaagcctttcaatcagttcgaggagaagatcagcacaggacccctgggggacttgtcccggggctaccaagagacactgccttcctacgctcaggtgggggcacaagaagtggagggcgaggggccgcctgcagaggagggagccgaacccgaggtgggagagaagaaggaggaagcagagaggctgaccacggaggagcaggagaaggtggccgtgccagagggggagaaagtagagacccccggagtggataaggagggtgaaaaagaagagccgcagtcggagaaggtgtcaaagcaagggctgccagctgagaagacaccttcactctgtccagagctgacaacagatgatgccagacccctgagcaggctaagcaaagccagcagccgagccaggtcagacgatctaaccgtatgaagtgacgccaaagaaaaaaaaaaaaacgcccaagcttacgtagggcaagatgaaaggaaaaggtgccaacatgatctgaatcttctgtctcctgtcctcccaccagcctctggttggacaggcactgcagcagggcagtgcactccaggcaactctaggaaacagtctttcccgcatccagcataagggctaccaagataaacccatcgacccactaaagttccccagtctcataggactaccccgctcctccaaccccagcagctatgggtgactcttctttcatccccatttctccatagaaacccttaaatcggaattggggttgcctcatagccttttacccatcttgtctcaagctcactaagccagaatctatcatcccagcatttctgaagcagataccatgtgaccatatttcagggatccagactcaaaagcctacagaatacagacaggtgacataagttgcaagacaggcctgttctaatgcaagggagagaatggggctgtgaaagttggaaagcaggggcagctgctgctcacttccagacaatgagtaccatgaagtgttacctggtctttctgatttttcaagggaagccagaaatccaaccttttttttagacaggctctctcttgcccaggctggggtgcagtggcacaatctcagctcactgcagcctcaacctcccaagctcaagtgatcctctcaccttagcctcccaagtagctgggactataggcgcacaccaccacacccggctaatttttgtattttttgtacagatggcgtttcaccatgttgcctaggctgatctcaaactcctgggttcaagtgatccacccacctcagcctcctataatgctgggattacaggtgtatgccaccgtgcctggcccatgaaatctaaattttaattgaaattttcaaaattgttaatgttggcaactaaattttaaatacaacatgtggaccaaatgaaatatgtgcaagccacatttaacctgtgaggcaccaatttgcaatatcagcttatgctaattagcccagctttcctatggaatcggtcttattatttatggtctcaacttgtttctgtggctcctaaaccttatttcactactttggagtgttttgtttaaatcatcagtccaggagatatctaaagttctcactgaccattcttttggctcattgtagcccctgggttctgaagcaatgatatgctttgtattggtgggaattctgccctgggtaccatcagagaaagagagcaagttgccaaaactctctctgtgaaatcaaaaggctttgaggcctggttgtagtttgtttttcctgaagcaaagaagatcctttctttattcccctcttgcagcatcagtgctcagcctaaaatctataccttttttcactagtgactagaagcaagcccagtttcgagctggaggacatctgctcacaggcatgtcctgggaagaggcagctctcagacatgatcaaagggccatcagggtggcaccagagggagcctctcacaaagtgggtgctcacacagccaggatcccaaagtggagtctcaggccaagcttcatccctggaaaggacacagaggctaaagggaacaagaagaatcttgaagggctcctgtcctcatattcccacaactcaccctcctcaaacacagagtctgttcaggggaaatcctcatgtacacgtacatatttcataccaggagcaattttaccctcagccaattgatttccagagcaaggagagaaaactaagatggttcacctaaagcaacactatgcttcatggactgcagtgccaaagatagggtaggaggtatagaaaccaagttgacatagcagggacctggacaggagaccagcaaggggcccaaaagggatacttagaaaaactgcgtttgttgtatcttcccaaccccgatcagcatcatctcaaagtatatcaatcccctttgctgccctctggttaccaccttccttttaagatattcattcaagatatacctttccaaagcaggccttttccaaaactattcctcccccttgacaaaatttccattccttggtgacccattctaaagcaaagtagtctaaaaattaaattcattctaaggtttgattgttcggtaactactcctggggaaaaaactgcatttaaaagagaaagactaaaatatatttttacctaggtaacccaaagtgacaaaccttcagtggagggatgttgaatagaagaggtatgtttatcttggaggcacgtgattttctggctactgcttaatcttacccctagcaagcaacgttattctacacagactttctcctatatggtgagagaattaacacaatccgaggcctgagaaccagagagtgcatccttgactctaatggctgcactattgctcccatagttttgttcctgaagatgcattttaggaagagccttatgaatagcttgatcattaccagaataaagtgtctatctcaactagagcctaatacaaaaaagaaaaagaaaaacgatatcctgttctaaataaaactgctgtttggtaccagttgtagaaatgagggctactggtctccttatctcaggtgggacataagtgtgtgatagagcgtctttcctcagatgaggcagtatcctgcttcaatgaacgtacccacactgtccccacattttccctcttagtcttcccaataaaaggagaagcctatttaggaagaaacagacacaggcatcaaggggctgcattttttttctatttctgccatttagtagctgtatcattattgtgccttgagctctctttacttcagttttctgtctacaaactaaagctggcatttgccacctacctacatccaggggtgtcctaaagattgagttggctgccaagcatgaggcctgctgagtggtaccattccctgagagattcctccaacagcagtaagactgggaagaagggcaggtggatggtttccatctgtccctccaacctgcctcgtagttacctggtgagtttttcaacgtgaaatagacactccagagatcacttttctcagaagagattcaaaacagaatttaaccccatatgtttagtaggaacctgaggctcattgaccttaataaatgactggagacagattgccaattactttcattctctgagaaagaggtcccatcttaagcggccacacaaacacagccagtttccatttagaagcagctgcatgtctgtggtggtctttactctaggcagctacaccactcagcatctgttttgaggcaaataattatgactgagtcaggattataatccccatgggcttcattatgtccagatttcatttctactcctagtcggtcccttgttagataaaaaccctagggcacatggacctaccaataaaaagatgcattagacagcgggacatcagtagtacagctccctccagaggaaaagggctaatcacttgatagcagttctaacaccaccctcaggggatatctgtgaccaagaatagatgtactcaaagttcagtgagaaagttttgagcctggctgtgtaaaccctggcctagtgttttgggcattatttaaaaaaaaaaaaaaaaaaaagaaagaaaagaaagaaaaaagcctgtctgcttttcaccatgtctttgtcccctgccacacagggaagcatccagtacagcactggacagatattcctgaaggtctgtgtgacctggggacccacaaagaacactgacattcaagtcaggggtgttgattgcccctcctgactctgggtattccaagatgccacttacctgctctatgagacaattttctctatgttagttgaggatgataagttctgcccctccttcacaagatgttataggtcttttttaaagctcactaatttggaaataaatggaaaagaaagaagccatcatcaaattttgtaagaccatattgtaaaatgtatactgaagcagtgacagtcatcactttcaaatactgcatagattgttaactaagatactgataaaaagtgagccaataactaaagtaagggaaataaatttggaggggcagcaggtagtcttgaattcctaagaattatggtacaaaaaaaagaatgtctttaatcacgcaagaattggttgctgaaagaggtgctaaaggtactcggcttagtagagctcacatatggagaagcgtcaacccctgagataatctctgactcatggcagaaggggctccatggatacggaaagagctgcatgcaggaactcttcagtccaggccatgtggaaggcctaggacaagattggtacaaaccactgctcctctccagttcccgagaagggtcattaggcgtgctctaagtaagaatgagaacaccaccccaactgcatgtcccattccattcccccagcctcctcttctctcctttccctgaccatgatttaccctctatgcatactgtgtgcaaatgattgcccaacccagcttagcaaagtttagatgagaaaggtttgcctggttggaagaaaaactcttctgagtgtaaatacaatctgtaaaactactaagtgtgtacctagaagtgatagcgaaataggcaaggagactttccccttttgcaattattgtattataactaaatatgtacttggggaagggaggagaaaaaggaaaaaaaattctcggttcagcatttgggtaagaggaaagaaaaacttttatgaaagacagttcactctccactgccctagacattgcagctcccagagccaggaaaaagtggtattcagctctgggaaccgaataccacataaaaaagtagccaccaagttgcagtgggacatcccatagtctccaacgccactgctttctggaagttctacagagcagacaaagaagattctaaaagaattcataaggttgtctgaagggaaaagtagatgaccccatggcctttttctgcaattttttcatctataaaacaaagtggtaaagactcagtttgttatgaagcacattcataacaaacttcctggggaaatctctggcaaaagagagacacgttattgggatggtggtcctgtattctccaaccttccacatccttgtgccagagctaatagtcgtgtgttagactgttacaaagcaaataaaattaacttgacttttcaccatctttgttttttctttttacgtgtcagctgaagtagactgtgaagagactgcctcagtttctagttatttttcctttggagttgagggcctagaaaacaaggcgagtggggtaaaggtggtgaggttggtatgttagtaaatgttcaaccaccagctctctccagggtaaagaaggcagactttgtagtgtttgccaatttccttggtttaaattatcccactgccaccaatttcaagctaccaacctaatgccactgaatgcagagttgggaagatgtgcagtagcataacatgataagggtttccaccatacgactgatgtgtaccattgagtaggtataaataacctcaagaacatagacgatagtaaaataattaggaagtgatcagctttgaatatttattacctttgcatttcatatcttttttatttaaatgtatataacttaattgttaataatgactgttcttaacaaatgactcacagaattcctgaaaatttagcaaatgactcttgtcagccagtacaaaccagctccaacacaccactgggtgggatggaagagaatctgattcagaaagagcatgaaaactttcttgatcaattgagatttggtccattttttttccctctctttcactacacaaatctcaggaaaaaataaactgtatatttgtttggactatggaaaggtgcgatagaatgatatttgttctcttccatgtcaatgagaactacagaaagagttaactttgttcattacaggtaaaaataaactgataacaaaataaaattagccaaaagcttctgtctgggatttatcatgtcacttctctgctcatattccttcaacagctcttcattgcctacccaataaattctagatttttttaacatgacttttgaagccctttattactgactccaactcacctagagactacgtctgtttttacctgaccagaatctattcttccttcttttacaatctccatttcacctatgggaaacatccttcctcaattagatgtagtcttagtgaacccttagtcatgttaacccagcatcccctggtcaagggtcaggtttttggacccaaatgggccagtcactctctccctggaatgtgaatcttgaataagagtaacaaagaaactgaaaattggttggaattcatttatcttggcagaagctccagaagaaaaattcacaattagtttctgcttacctagatttccagatgtttggctccacatttttcagatcatggttcttcagccttccttcaatttgctaagctacctaagctacctctgagttcctttttgtttttttaatttaacatagccaaaatcatctccattgcttgccagcacagcccgactagtacaccacctttctagcctcacctcccacatttgtctacacataactgtgccccagccttacagaaccattggccagtccccaatatggagagtcctggcagatcacgatgaaagtcatgttgtttcaggactctgtgctctgtcctgcctttttcctactgtcagcttcttctcatcctatgagagtcagctcagttgtctttctctttatgaaattttacaaacttcccaagaaaagtcagttgcccccccctttgtggtccctcagtacttttgtgcccttctatcatagcacttaccaaattgttgtatttacttgcttttctcccatctgactgcaagcaactttaggacagagattttatcctatatcactgaatattcagtagttagcacagtgcctggaacgttgtaatgtttgctgaatgaatgaatgattagtgagacatctcccagggcaggaagaagataatcagccaagcacttcccagcaatagagcaagttgacactacgcaggcatgtatctgaggaagaggttcactgaaggtcccaggcgttccaggcttgaaagcaagcaaactttctttgtcataagtaaaaataaaggaagaaaaagatattttcatatgaattactggatgttgtcacctagagcaaccccagaagccacatattaaagatagcatccttatgttaaagatgctgtcacccagagcaaccttggaagccatgttatgaagatgtcagtttttgaacagttgttgatcagagggcttcccaccctgcaaattcccattaattggacttttagaccttacatgagatgaaaaataaacttttattgtattaatccactcagatgtcaagatttatcggttacggtacctagcattatctatttacagaaattggtacattgaggttaggtgtgattgtaacaaaaacttaaaatatgtggcttaacagtcagtgattggtaaaaaacaaaaatcaaagcctacaaagatggagacccaggtttgtactatgcaaatatttaataaaaatattacttgtgatgacttgtgtatttgttgtatattgctgtgtaacaaatcactctaaaacttagtgggttaaaacaacaagcatatcttatccctcacagtttctgtaggtcaggaatcctagagcagcttgggtggggtctgttggaagactgcagtcaaatataggtgggaccttcagttatcagaggtttgactaggatggtaggatccactcattcacatggctgcacaactaccaagttaatgctggcaagttggtttctctccacttgggcccctccatggtgctgcttgagtgtccttatgacccagtagctggtttcccccagagaaagtgattcaagagacaaagcagaaacttcaatgtcttttatgacctaaccttggaagtcgcataccatcgattccaccgtattctctcagactgccccgaccactgtggagagaataaactagaaagaagcaagatttaaggcaaagacatcaattttggctcttttttctgtttcaatgatttcattgtacgtataatatgcattgtaatctgctctaaatgcttctgttcaattgtcaccataaaggaagccctcatccaaggataatgtgtggtcatgacccctttggccaggacagtttttgtgtcctctttttttcttttcctccagcatctgtttttctctgatactcagctttcctgaaaactgtttagtgtttctaattcatccaagttttccagttgtatttttctttctcatctgctgcagttttcatctttaaactagctagatctgtagatggaagaaaaaatgaggtacctctaaaattgagttagatcaatgtaaccaacagaaaatgatgagattagataaacacaagagacctgagccaatggaatataacttaacaattaaaaaaactcagtaatatctatagggcagatattatgacggggatgatattacaacaattgttcatctctctaagatctctcagatcagaaggtcaactttcttcagttttttttcataattgtatcagcctatggcactaaattctaggacaactctatatttttcttgaattatagtttacttgtcttcctttaaatttttttttttttttttttgagacggagtctcgctctgtcacccaggctggagtgcagtggctcaatctcggctcactcactgcaagctctgcctcccgggttcacgccattctcctgcctcagcctcccaagtagctaggactacaggcgcccgccaccatgcccggctaattttttgtattttttagtagagacggggtttcccgtgttagccaggatggtcttgatttcctgacctcgtgatccgcccgccttggcctcccaaagtgctgggattacaggcgtgagccaccgcacccggccaaatattttttagaaatttacttatccaatagtcaaacaggattcttctttacatttttattaattctgctgacctaattttactgtgtctagtcaggtcctatatctattctgggatggatgagattctcagttttatagataagtaatagacagggaaaataacaacaactagacagagaataacctggagtctgtggaaggtttcagagacaagagaagaaaacaataaacaccaaaagtaaaagaatggcataatttcaaaaaatctttacttaaaaaagtaaaaatttacttaaaatctgtttgtactctcaaaaaaaaagggttaaagaaaacatggactctataaaacaatacatgaaacaagataataaggtactagattgaattgtaaaaggagctggcagagttagcaaacaatgccacagcagaatttaagaataaagagcagaattagcaatacataaaaccaaatcaattttgtaaagaatcaatatcagaaattctcccaaatgccaaaagaaaggacaaagagatgaaaattatcaaagaagaaataatagatatggaggaaagacaataaaaatccaacacatggatatcgatgctcctgaagaaaagtcaggacaagtgaaccgtaagctctaaagatacaatagaaggaaattttcttgagccgataaaagacctaaaattgcaaattggaagggattcatcatgcaccagggaaaaaatctagataaattttgatttgcaagtataaagacataattctataatttagaaatgtaatggaacaacccctgcaatggtttttgtaccactgtttaacaactatgttttcacattcttgtctgcttgtgaacagagagtagggtcatacctctctcaataggaggtgaggcttccttgaagataatagatatttcaaatgtcaactgctgaaaagagaaagattctaagatgagaaaagagaatttggaaggtgggccttaaacaggaacaaaagggaattcctttctctgagcctcattctcttgagcctacaatccaaagagtcataatatgctcgctattgcttccaaaaaaagaagggaaaatggcatctgccagatggaggcaagctaggaactaagttggagagttaatgagttaatacaagtcaagatcttaaaacagtacctggcacatggtaagcattccacaaatgttagctatcatcaccttcataattatcattctatgtgatatgatcactgtaatttagcatagccttattattattattgagacagtcttgctctgtcacccatgctggagtccagtggcacaatctcagctcactgcaacctccacctcccaagttcaagcaattctcctgcctcagcctccagagtagctgagactgcagctgcatgccaccatgcctggctaatttttgtatttttagtacagacttggttgcaccctgttggccaggcttgtctcgagctcctgaccttgtgatctacccacctcagcctcccaaagtgctggggttacaggatgagccactgcgcccggcctagtcttattattaaatgatgtaccttagactcagctttgatagcaatttaagaaaagggtttatgtggtctggagggtgaaggagagagattcctcctctccctcagaggccactgttgctcatagggatgagtaatagcccaaaagggaaagggaagctggagtgagcataaggaaccaaaaactcatggctctcagtttcagccaaccctctcaacgtcgcgctagtccttccagtgccaactgtggatgaacagagcatatatcaagttactcacaaaggaaaaaaaacatcaggctggcatcatgcttctccacaacacattaaatttcagaaaagagaacattatccacagaatattgcggatgaaaaacttaagctgaaaactccacaacaagccaaatttcattcatgtgtgaagccaattgaaaggcactctcaattatgcaaaagctcaaaatacctgcaaacccttctttaaagaaaaaatgtatttcataagcctatatatatatatatgtagatatatatacatgtagatatatatatagatatatatatagatatatagatatatatatagatctatatatagatctctatatatatctatatatagatctatatatatagatctctatatatatctatatatatatttatttttttgaggcggagttttactcttgtcgcccaggctggagtgcaatggcatgatctcggctcattcaacctccacctcccgggttcaagagattctcgtgcctcagcctcatgagtagctgggattagaggcgtgtgccaccacacctggctaatttttggattattagtagagacagggtttcaccatgttggccaggctggtctcgaactcctgacctcaggtgatccacccgtttcagcctcccaaagtgctgggattacaggcattacccaccacgcccgcccaagagaaatattttttaaaagaattcaaggctcaagaatagtggctcatacctgtaattccaacattttgagaggcagaggtgggaggactgcttgagcccaggagtttgagactagcctgggcacattgtaagaccctgtctctacaaaaatttaaaaattagccaggcatggtggcacatgcctatagtcccagctacttgagaagctgaggtgggaggatcacttgagcccaggaactatagtgagctgtgatcatgccactgcactccagcctgaacagcaaagtgagatgctgtctcaggaaaaaaaaaaaaaaaaagaaatcaaaaaggcaaagtatgaaagaggctgatgatgaatactgaagacatttaagcataaaatgaattaaatgtaactattttacgtataattacaaaacagaagacaaatatcataaatattccctaacaaaaatatatttttaaagtaaggtttaaaatcccagattacaccaacataaacttgggtattgtgtggggtgaagggagtaacaaggagaaacgtgagaaagtagaagtgtcctggtattctcaacgtacaaagatactattttattctgtatgttagtaataagaaaaatataaagttgtgtgtgttattttaaaacaaaatgcatgccttccagattactaggaaacaaaacaagaaacaaggactacacagtccatacagcaaaaagaagaaaaaacagaaaaaaggcaaaaataaagaccaaacacacaaaatacgagagcagaataattaaatcaaaccaaaatattgatctttattaatataaaatataatatgcaacaaagacatactgtgaatcattttgcactgaaaaataaggcattggactgtatgaagctctcagaaatatatggagatatggacagaaaaataatagtgataaaagacttcagtccttgacgaattgatagaagacaaaaatagagaggacctaaatgtaatttacaagtctgatttaatggatatgtaatgaaatgttaaacaaaatacttcctatgtcttggagtttcagtaaggctacataaccaaggacaataaatgctcaatgtctatactctctaaaaagtggtacaaagcacaatctagaattgctttaaaaaaaaaaaagtagcccccaaacagtcttgcaactcctagctcacaatccacctctgggttatttaagagaacgataagggttaactgataggagcagtctttgaagagagttgtcagactagaagaaagagctgtggtgtttctcacccccttccctcactcccctccaagtgaggggctcaaggaaaacccctgagactttttgggaagcacttgctgggagggaggcctgacctctttctcactagtcattagtggcctattggtctgcagaagttcacaggctcatctccggctaccacagtagccaagcttgcaggaccttgatgtgtgtcctcagaatttgctggaacatagacacagtgaccttcccttgcccagggaaaattggaggcttgaataagtgtttcttgtgggccaaattcttcaccatcatattattttattatagtaaacaccaccaaaaaaataatccaaaaggtagattggttaacttactcatgagataaccatatgatggaatgttactgagtcaataaaaatgctataaagtctttggcaaaagaaaatattcataatatacattttttttgagacacccaggctggaatgcagtggtgcaatcacagattattacagcctcaacctcataggctcaagcaatccccacacttcagcctccagagtatctgggattacaggtgtgcaccaccatgcctggctaatttttttttttttttaatagagacagggtctcccaatgttatccaggttggtctcaaactcctggactcaagtaatcctctcacttcggcctcccaaagtgctgggattacaagttttagccaccatgcctgtcctataatatatttcttttttttgttgttttttgtttgtttgtttgttttttgttttttagacaaagtcttgctctgtcacccagcctggagtgcagtggcacaatctcggctcactgcaacctccgcctcccaggttcaagcaattcttctgcctcagcctcccaagtaggtgggattacaggcatgtgccaccatgcccagctaatttttgtatttttagtagagatggggtttcaccatgttggccaggctggtctcaaactcctgacctgaagtgatccacccacctcggcctcccaaagtgctgggactacgggcgtgagccaccatgcccagccccataatatatttctaaaatgaaatataatgaaaactatgtaacaacatagtatgctcattgtcttagttcaagctactataacaagataccatacattgggtggcttcaacaacaaactttaaaaaattttttattcttaagttttatgggtgcatagtaggtgtatatatttaacaaacatttatttcttacagttccagatgccagaagtccaagatcagggtgccagcatggtcacttcttggtgagggccctccttctggttcacagacagctgccttctcaccatatactcacctgtcagaaagagagtgtgctggtccttcatctccttggaagggcacaaatcccatcatggggcttcactctcattacctcatctaaacctaatcagctcccaaaggcccctcctccaaatactatcacatcggaaaccagggcttcaacatatgcattttgggggtacacaaacaggatccattttttcaatattggatcactaggagtccatagcactccttgtgatccagttttgggaaaatcaaaaggtatatgtgcattggtgtgggtatgcatcacgttaaccaagaataagaatgaatatcccagactttggaaatatgccagtgttgtactcctttgcaactgtcttaatgtcatggtggcaaatctcaatccagtggtaaaggtgggcacttctttaaaataagcaaatgtccctgctggtagttatcccaaaaagaagttagtcctggagcaagaagtggtggggcagtagggagagctttctgctctgcctgagcacagacagcaggggaccagaagtttggaacagttcatacattaagaatatgaacatcctttactttgaacttcaactaatatattccatttaaaatttaatctctacacattcttcccctttgttcacaaaatatatggatcaaattcattctgcatgataattatattaacagagaatcccaaaattagttttaataaatggaaaaagttggtgttatatatttcaaataatgccgctgaatctttccaaatttgggagctctacaatcatcaatcttttcagtataatttgaataactgacaaccaaaacttttaaacatacatttataaatattaataaataaatatacattgaaactaattaacaatgaaggaaaactgaacgtaaactcataataataataatgggtaaaaattattgcatacttactataaagtgcttattttcctgagggctttatgtatattaatcttcataatagccttatgagataaggtactattactatctctattttttagatgaggaaactgaagtacagagagtttagtaacttgcataaaaccacacaactatttaatcttctttattcctcaggaacacggcctcaagaacaaccaagcacttgatacagagttaactctaactcatatgaaccaatcagtgcacaccaggtcagcaccaaggtcaatatatccaaaatgagattgtataagaggaaaggaccggaatgcacctccaagaaggtctggcaaagtgagaatcagctaggcaagaggttcaaagtagactcaaggaagatgaaggggaattcttgagccaaagcacaagtggttggaaaagatttttaggcttcctgaggctgtggagtgagcatatctagagaaaggggggtgggagtggaaaaaaggaaagagcaaagctagcaccactctggcccttagtcccctttctctaggcaaatcagaactggcattttcctagtgtgaaggcgctgactcactctaggaaagttttgaggtggggagcagagtctcacaaccagtccccagtcagtgtgcataagaatctcctgggaagctgttaaaaatgcagattacttctaaaaaaaaaattgaatgcacaaaagcagagagtagagtggagattaccaggggctgggggggggatagttgggtggggtaggggagatgttggtcaaaggaaatttcagttagataacaagagtaagttcaagagatctattgtacaatatggtgactatagttaataacaatgtatccatttttgaaaatctctaagagagtagattttaagtattctcaccacaaaaaataagtatctgaagtaatacatatgctaattaccttgatttagccattccacaatgtatacatatttcaagacatcattttgtgcatgataaatgtatataatttttatatattatgactcccagattcctcctcagagtcactttcagaaatcccaagtccactggtctacattagggcttatgaatctacattttaaataagccccccaagtcgttagagaaccacactttgagaaaactgcacctatacattttctaggtatcaagtatagatactgtccatgggaccattgggaaataaacacttttcctctgaatacttggggtttcctgtccagcttacactggtgacttagtggggcaaacaggggagttcagagactcagtgaacctggcacagtaggcaaaactacaagataggatgtctatccatgaagggagacagcgggagtaggatgccacagaattggtgatatcatatgtctcaaaagatcccagacttacaactgcatgtgaatctacaactatgtcacagtaagtaaaaattttcaagagaaaatccctaacagagatcatccagccactggcatgagcaggtgctatgtatgtgcatggagaagaggtactagggtgtctcccagggatctagtgttagtgtcaactcctgggcccagtcctttgcattaatttggaggaaggggatgaagtagttagctgtcagtatgtggatggtgctgggaagtgtgagagtaccgtaggtatgaacattgcagttgctatgacaaaggacagtaaagtggtgtgagcaaacactcatccaaaggacacagactgatcatcttgtcagtcgactctttgtagcacatctatgggactggctgccaatctctggatgagtggcaaacaatggctactagttatgaacatgacatattttgaaaagctcccttggaaaaagcacaaactggggactcagagcccagatggtgtgactgtccatggaggcagaaccaaaagatcccactattctaagaggatggcagcagctagagtggatcgggagaatattaccagcggtagagatgggaggacaagccattttagtgtcagagtccaccaccagcagaagagacttgctttgaaaggagagtcaattggatactaaatgctgtgcgaaggtttctaaagacattcctcaatcaaaatcaggggataaagcagtcgcttgaatcacctaggcctgtcctttacctggacacaagtggtacagtagggagaattctgaatagtgtcacccaaagctttgcataggccttaggccagcaggtattgcacacctttctctgctattcctcgttactgatattctgatccccactgtgcaccccagtaagccaccaaggtaaactgcttgccttgatagtctctttcagcactctgcactctacacactcttgaatgtcagttaggtgctgttatgtgggaatctacctgcttacctaatagacatagcctggacacaaagttctctggtttatgacactcccattgtacagctgcctccacagctccttgaaattctggatcagggattggacatctgacaggtagttttgactgcttggtatcacagagttcaatccaacaaaaggaagacatgttcccttgtgtgtaatgaatctgcaggtcacttattcaaactatagtagtctgaactcagatgctggatgtcaggtcccctcaggattgtcttcctgcgtcttgactgcagccactcctacacagggtgatttcctgggctggagccagtttgcaggactatgagactatatagactacaaagcctagctaggccccaggtcggcggcagagtaagccccacagcaatgcgttaagccttcatgaaatgagtgttgaatgaatgaggtagtgattcagtgtatatttgatccactgcaacaggtgggaagggggcagaggcagctacttcctaaaataacccttcttcagactcttaaagaactgatccttgttttgaattaaaatctatcttcaattaacttccagtcctttgccctacagataattcgtagtgccacatcagttctacccattctttcacatgaagacagatgtcatgttctgagtcatctttcttcgcctccttccagcagcccttatctggtggctcacatttgagcgagctccaatatgtctctgtagaatctctctcttcttttttcttttctttttttttttttgagatggagtttcgctcttgttgcccaggctggagtgcaatggcgcgatctcggctcaccgcaacctcccctcccgggttcaagcgattctcctgcctcagcctccctagtagttgggattacaggcatgcaccaccacgcccggctaattttgtatttttagtagagacagggtttctccatgcttgtcaggctggttttgaacttgcgacctcaggtgatccgcccgccttggtctccccaggtgctgggattacaggtgtgagccggcccggcctgtaaaatctcttcaaagtgtggtacatggagtgcagtactccacctgtggcctgactgatatgcagtacaatattatcactaaattgctacagacagtgtgcttttcattgttgtcacagaaatgtatttggttagttatatttgttcatatctcatctgactttccagtcttccctcactttgtacagtcatatttgccgagtcaagtaaaagttataacatttaggacacaatgcccgacttactataattaccattattatcttaggatcattacaaaacagaattaccacttagctctcaggccctacctccttcagcctcagaaacgttaacgctaccttgcattgctgcttttagcaccgcccctaataagccccgcccctggggcttccgcggcggaagcctagcgtccgccccacccaccccgagcccgaggcggggctgtggatgtagccgctgattggctgactggggcgcagcttgacggcgtcgggctggagagccgcagtcccggctgcagcacctgggagaaggcagaccgtgtgagggggcctgtggccccagcgtgctgtggcctccgggagtgggaagtggaggcaggagccttccttacacttcgccatgagtttcctgatcgactccagcatcatgattacctcccaggtgagtcaccgcctcccgccccgacacccgtccgcctcccttcaccgaatcgccctctccggtcctccgcggtgcgggctggtccggggtctcgctcctctcttacgcggcctgcgccagtcactctggcacacagagagggtgtgcgatttgctgcggccggttccctcagccccggctgtcaggaggctggcctgcggccgtccgcgtccccacccggcatccatccccggaatttcggtccacttttggaagcggtccgccgacctccaggctaagagccggcgccgccagctaaggcggcggttctaggagctcctcgaagcttccgggctgcgccaactgatcctggactggggaagcctgtgtggttctgggcgcgcggtgtgcgacgcgccaatactggatactgaggacacgtcagtgcaggctttgctgttagatgtcaaatcctgaatccgggtgtggagaaatttgctgcttcaaagtatcagtataaggtaatacctatgcttgaaagtataaggtttcgtttttgcactgacacctcgtcctttatcctctgcttagttacccaccttttccggatgtttttctgaccctcatttcttctccattggccaccttcatttgtttgtacagtcaacaaacatttatcgaccattatataaagctctgagcgtaaaaacatgtaagacactgtctctgctcaatagaagtttcgtctagttagcctcttgcttttaccatgtaatctattgttaattattgtttcttcctagcattcatcatagcactggcatcatttatgtctgtgtttctgattttgttttttgagatcctgccttgttcatagctgtatccccacttccaaatgcaggcattcaataaataattgttggccaatatttgtgaagctcagactgcctgttgaccttcttcccctcatctttccaataaagattttgtgtgtgtgtgtttgtttttgcttgttctttctctcaaacggcaaataacagaaacagttacctttgggggcttaaagtgaactaaatttgtgttctttgattcagtttttgtattgcttcatcctaatactcgtctccgtagagcggagcattgtccttttctcttcaaaaacttgtttacaatatttaagaaaataagaaagaaggaaaagccatccataatcctaccgctctaatgcaatagttttttcatttttaaaatttaccaccttttctatagttttcataagtattgtttttattggctgcatagtattcaaatgtattaatgtaaaaaaacctagacatgtaactcttctgcttaaaacctttctaagactacccagtgcccttggtgacaactcaggattatttttagccttagtaccaatttaagaaaaataacaatatttaattagcttttcttttcacttagaataaagataagaatgtcagtagaaaattggctttgcattgcagcctctacgatttttagcatggatataattgatacgttgaaccaaggaagtggctttctaattttgtatgccttataatcatagactttcacttcacacatgtatccatatgcagtaattaattgttaaacctggtttttacaaatgtggaagaaagacccaaagattcctttgcatggaatgttctctgttcagatatttatgtggctactttatcatcctttcggtattaataaaaatgtcgctttaggaaggttttacctgacaccctgcccacaaccaaagtagctttccatttcggctgccttcttcctcatttccatgttttattatcttcttggcatttattactatggttcatttgtatattcatgtgtttgttatctgtccatgaagtccaagatactgtctgtcttgttctctcctgtattcaccagcatctagatcagttgcaggcacatagtagagttgtagtgaatatttgtttaataaaaagcacctctctagagaggtgtggttaccttggaaacaccaccattgccccctgcgcccctccctgctcattttttctgttttgtattaactgaaaggtttatttgaaatgaaatctgaaatcagaggtcacgtattgaatcttgctcaccacggcacaggatgaagttcaaactcctttacatggcttttcaggtcccttattgatgggaccctggctcttctctcttcagctgtggctccaatttattctttagacttcctgaacttcttttagttccctaacctggccatgctatggtgcctccagatttccacacagtgtgttttctctttctgggccttttcctcatatccctcccctttaagccttcagatctcaagttgaacacccaagaagcttcccctagactggactagatgtccctatacctactgccatagtacccttcacctacttcccctgtaacaacactaccacattgttttgtaattacttgtttatctcctccatagattataaactccttgagagtagcattcatgctctcatttgccattctatcccttggacctggcacatattaggcactaataaatatttgttaaatgattaaaagggtgaataaatgatccaagaaaggtgtcttttatagttaattctttaataactgtcctgctgatggccatctttttttttttaacagtagctaattttcaacccagaagtcactttttaaaaagcaactgttaactaactcatgttttaagccctctataccgtcataagacttatcagttccagagtacactcttaagtcctaaggtcaagactctgtacaattctgaaagtattaagtctcatttttaataagaagctatacgccttccattttatttgcaaagctatttgaaattgcattttgcttctgctttctttttggatcctctataatcttgccagaatttgtgtttacttggatgtaaatgaattctccagctacttgtgtgtgtgtgtgtagtttaagtcttttttttttttcaacttttattttattttagatttggtacttgtgctgggtatattgtgggagctgaggtttggggtacaaatgatccggtcacccaggtactgagcgtagtactcaataattagtttttcaacccttcccccttctcccctcccctgcccccaagtagtctccagtttctgtttttgccatctttatgttggtgagtacccaatatttagctcccacttagaagtgagaacatgtggtatttggttttctgttcttgggttaatttgcttaggatgatggcctctagctgcatctgtgttgctgcaaaggacataattttgttctgaaagtctttttaagctttctttgtcaatgtgaaaggaggccacaatgaaatattaaaggtatatatctgtttctcttttcttccattcccctccccaccatataaacttaaaatttttgcttgttttctcttccatttcatagcaatcttggtgatttttttttttaatcatccatttccactatacataccaccatcagtcctaaactgcccaacttctctgtcttcagtcgtggcttcataagtcatataaatatggtctctaaactctgaatttacatctgtctccaccggtaaatatttataatagccaaaggatatcctggacattttctcctaatctgtttgaccctttccttttctgcttgatctagatgcttggatccaacttactttcttaaaccctcttgttcgtttaccttcatgtatatgtaagtccacacttggatcactgctatagtttgtttactactaatacagaggcctgaaggctactatagaaaatcacatagctgtgtagtttgccaacgccaggagtttaaccctcagctcactgaattattccttttcttgaccttaatcagctacttgtttcattcccctcaaagtttctctgaatctttgtcactctcctcaaagctcccttttctaactcacctctcttactcttagcagataaccatgcctcgtacttactcaacaaaagtgaagccaaaaggtatgatctcctactgtgaatactttctgcattttaatctaaaaggttatctgtgttcacaaccattcttacctcctttcctcccatttcagaaaacggggttcccctactccggtttaaagccattctacctacctttgatcttagagtagcgtattttgaagtggttaaaagcacagaatttctaaacagacagactcaataagagctgaaaaaataatatttaaaaaaaagcacagattttggagtcaaacaagcttgagttcaatcttgattctgacacttactataaattgattaacttctctaaacctcatctttctctgtgaaaataggataatcaaaccactgtactgagtttttaattatttttataagattataatgctaagtactacttagcctggagtatagtaaatgctcaataaaagttacctaataatattaataatagtattatcagttcatcctctagtattccaccatccttctcatctttttctccttacttgactgctttctttccccttggccaataaactttccctttattccacattcttctctagcctattatctaatgttttctttttttctcattcctggctctccctagagtaatttgcatttactgtccccactgctttagctcccattcattctgacctgctacactctggttcctgcctctacctcaccattcaaaattgttttccttatcctctagtgttttcttcttggcacattgctctccttactctagatactattcccaggtgatctcatgtactttggtggtttcaactcataggtatatcttagacctgccttcacaatctgtcttttattccagatacttgctggatatcttgacccatcttgctggctgtccctcaggcccttagtgtgttcaaaaatgagctcatcattttccccatcctctgccccctttcctaaacctcttctttctccagtattctttatataaattgggtagcttcactcttcatcctgtattccaaactagtcatccttgacttctccctgttgattttaccttctaaatagttctcaaatctgttttctcctcttctgtcaccaaatgtcttaattcagggctttatcatctttcatctgaattcccataacacatttctataatgtttctctttctacactgtcgcttccttcaagtgtgtcttccacacagccaccataccgctctatataatataaaacaaatcagaccatgccatttccctgcttaaataaccctcaccacctacagactataatctaagctccttagggtggccttcaaagctctcagtgattggacatccactcctcctgtctagcctcatttttaacctcttccttctttgaatttcatcttctagcagcaccaaaccatgtgtagttcccggcatataccatgctattcactctgcgcctttactcatgccctttgctatctggaaagccctgtcctcctacccctaccacctgtttttaccctacctgattcgttttttgtttgtttgttttgttttgagacagggtttcgctctgtcacccaggctggaatgcagtgacatgctcacagctcactataacgtctacctgccaggctcaagtggcccttccacttcagcctccccataagctggaactacaggcatgcaccaccatagctagctaatttttgtattttttgtagagatggggtttcaccacgttgcccaagctggtctcgaactcctgggctcaagcgatctacccaaagtgctaggattacagacgtgagccaccatgtccagcctccctacttgattcttattcatcctttgagaggatggtttttatgttaggggtggtggaaacctttgactgtgtgatgaataccttgaaagcactctagaaaaatgcacataaccccaaaatgtgcatacaatatcaggttttaaccccaaattaaaacttccttcggctcgggcattatcttctccagaaaatctgtcctaaccccctacagattggtttggtctccctctttcatattgttttacaatatcatgtatgtatttctatcattgcacatccatattatgttataattatttatgtactgtcttcactatattgtgagctcctagagggtagtaaccatcctattcatctttgtatcctcagcacttagcatagcacataggagttattacagaaaatttaagattgaatgctgaagaataaaccatcttttatgtagaccacttagccattcagcaagcacttatggagagcctgctacgtaccaggctttgtgctggatgccaaggatacaaagattacaagacaaacatggtttttgtcctcatagagcttataatctaatgtcaaaaaatatttaaatcacacattacaaaactgtatggtaagcactttgatgagggaagtacaatgtaaaacaggattatataaaaagagcaatttatctgcatttgggagggcagagagggccttccagggggagtaaatggcataactgggagagggctagagagaagttcctttcagaggacatctacacaggtctcgatgtgaaagaatatggatctaaagaaccaaagaagttccagggggctgaacacatgagtttgctaggcagcaggggcatgataagaagctaaagtagtctgtgctaaactactgagtttacacttgctcagtaaagtagtccctagaaagacataaaatcattttattcataagggtcctagccagtttaagaagaaaagagtagttgtgtcagtgtgtatgtatagaaagttctgtttactacagaccagctttgtcagctgtcatgtggctacggtctctgccagtttgaaacaaaactgacgaaagagggatcctgcaatctctcggctttacactgagatgaaaaccacttttatgtagattaggcaggatggtggagaaggtaagaaaactctctgaaggaagcagatataaaaaatattaggctttctactactcctctaattttggtctcaactcctctcccctgaagtttttattttttaaattaatttatttttatttatttttgagacagggtctcactctgttgcccaggctggagcacagtggtgcaatcatggctcactgcagcctcaacttcctaggctcaggtgatcttcccacctcagcctcccaggtggctgggactacaggcacaccccaccacccccagctaatttttatgtgtgtgtgttttttgtagagacgggttttcaccatgttggccaggctagtattatttttaaatacttgcaatcagggatcatccataagaagcaagtctcactctgacaccttttctttttttttcgagacctagtctcactctatcacccaggctggaatgcagtggcacgatattggctctctgcaacctctgcctcccagattcaagcgattctcatgcctcagcctttggagtagctgggaatacaggtgcccacacccagctaatttttgtattttcagtagagacggtgctttgccatgttggccagactggtcttgaactcctggcttcaggtgatctgcccaccttgtcctcccgaagtgctgggattacaagtgtgaggcaccgtgcctggccactgactccttttctatttgcaaacttctctggctcatataatgattatcataagattatggcaaaatatgtacttccatttttgtcttaaagcatactctgtaacatggataacttcaaaactccaagggcatttaaaaatttatttccaatgtcatgagctttaataagtaggtcttataagagtggatcttatctttaatccctgaaataagttaaccgtctagttagcagaccttttatcataaaagagtttctataaaacatttctcaaaagaaaatatgtattgacattctatcttctttctcctccagatactattttttggatttgggtggcttttcttcatgcgccaattgtttaaagactatgaggtgagaagaaatcattttgtcatacttacactatatgaatttagattgacaagaaaaatgtctccattaaagaaacattatgttcatttccaagataggaagcttttaccaaataagtactatataactattagattggagaatataagtagacttaattgatttaaaaggggggaaaaaaggcaaatcaaatatagcccagaagttaggagcaaggattatgtcttagtcatatcaggatatgtaccaatagcaaatagttattctgtaggagagaatttaattcataatgtctcacaaatgttccctttcatttgtctatctggccctgaattgcaagccttatattataagttaataccaaaatcccaaggctatcaggggaaccagtccccaatatttcaacataggttctttctgttttccttaagtgtcggccggtctgagaaataaagagaaagagtacaaagagagaaattttacagctgggcctccaggagtgccatcacatattggtaggaccgtgatggtgactccgagccacaaaaccagcaagtttttattagggatttcaaaaggggagggagtgtatgaatagggagtgggtcacagagatcacatgctggaaagggcagtaaaatcacaaagcagaggcaaaaattagaattactgatgagggtctgtgtcccactgtgcacacattgtctttataaacattttaacaggaaatagggttcgagagcagacaaccagtctgactagaatttaccaggctggaatttcccaatcctagtaagtctgagggcactgtaggagaccagggtgtattttagtcctatctcaaccgcataagacagacactcccagagcggccattcatagacctccctcccagaatgcattccttccccagggttattccttgctggaaaaagaattcagcagtatttctcctactcgctttctgcaagaagaagaatatgactctattctgcccaaccctgcaagcagtcggaccttatggttatctttccgtgttccctgaaaattgctgttattctgttctttttcagggtgcactaatttcatattgttcaaacacacatgttttgcaaacaatttgtacagttaacgcaatcatcacagggtactgaggtgacatacatcctcagtttacaaagatgacgggattaagagattaaagtaagacaggcataagaaatttaaaaagtattaatttggggaactaataaatgtccatgaaatcttcacaatttatgttcagagattgcagtaaagacaggcgtaagaaattataaaagtattaattttgggaactaataaatgtccatgaaacaatttatgttcttctgctgcggcttcagccagtccctccattcggggtccctgacttcccgcaacacaaggctggtgttgtttttatcttaagctttggattcagaagatcaccaccctagactcgacatttcctaattagttctcctaattagtaataagatcagttgttatagtctacatttgggtcatttctaggatgttctccattaaactttcccagggagtttattgtctgaaagagcctgggattctggagattttcttctgcccaatactttaagacctcccgaggaaggttccagaactgatccaggatctgcagagtgttgaagaacccctttaaacattaaccattatgtacgaatctgtcagttttttgtcagtatgcatcaggaattctaagtgctacctatgaccctgtcacttcatcttcttgtcctcaaaattcttcatccacaggaggatgctggtaatagtgactcaagattcagaagtgccacctatattgatctttttctttagctccaggcaagttgctgttgtggccctacttccaatgacttgagaatttcctcaaaataagttttctgccttgtaaccagaaggaggttatcagttcagtttttaaacaaggaaataacttctagtctctgtttggcttttaacagatacgtcagtatgttgtacaggtgatcttctccgtgacgtttgcattttcttgcaccatgtttgagctcatcatctttgaaatcttaggagtattgaatagcaggtgagtaagagtactgaaaactcctcttgaagagttctgtgctacattctttacagtggaaaagctattggatctcataactgaaaaaaaaaaaaacactgtgttaatagttcagtttcagtaactgcaatgatcacaacagatatgggtcacagccacctaatagctggtttgataaagattatgagataccaggaaacaaaagatctgaccgttaactctgaagaactcattggagtgaggctgtgaagctgcagtctaggcttcactcctagaagctttatttttccaggactgctcgctgactgaatcccagtaacagcccttcacattgttctgctgattgaaaatctctacctgaaaagattagaattcctcagagctactttaatgatctctctgaagactgaaactccagttcttacttaacttagttatttttattgattttacagtcatggtcaagtttggttgaatttaaagtgtttcttaaaacactttttaaaaataactctttactcccctccaaataatagacttgttagtttattagacagtctatccaaaatatttcttgcttgttaatctgcaagcttgagtatgtttttaggccagcatttatatgtagggttcatcaactatgctatgcagactttgttgtgcttttttatcaccacctggaaaaatcttttaggagtaaagcagtctttcactctaaagttaggattcagtgccaaggtaagttcattatagacccctggcacttgagacttgtagagagactatactctcaaatcctttgataatcagagttgaaaacgaaatttaaattaaaaagaaaaacttactatacagatggttaatcacaaaacattgaaaggttaaaaaaagagagaggggccagacatagtggctcacgcctataatcctagcactttgggaggctgaggcaggaggatcacttaagtgcaggggttcaagacgagcctgggcaacaaagtgagaccctgtctctacaaaaaaataaaaaaaatcagcagagtgtggtagtacacgtctgtagtgccagctaccctggaggctgaagcaggaggatcccttgagcccaggagtttgaggatatgcggtgagctgtgatcactggacaagacaatgagaccccatctcttaaaaaaaagagtgagagagagagaatcagagttgataataatggtctcttgatagaacaatgaataacatgtattatggtaaaatagaagtgttttctgattctcctgcttttaaactttaataatccaaaccttggccgggcgcggtggctcacgcctgtaatcccagcactttgggaggccaaggcgggcggatcacgaggtcaggagatcaagaccatcctggctaacatggtgaaaccccgtctctactaaaaatacaaaaaattagctgggcatggtggtgggcgcctgtagtcccagctacttggggggctgaggcaggagaatggcctgaacccaggaggcagagcttgcagtgagccgagattgtgccactgcactccagcctgggcgacagagcaagactccatctcaaaaaaataaataaataaaaaataatccaaaccttttcttggatgagctagatatagatcctgtgactatagagaatagacaggtattattttacataatggttattaaattttattatcacaacctgcatctttcactgctatttaagcaggggttggcagactttcttctgtaaagggccagatagtaaatattttaggtttctgtggaccagaaggtttctatcacaagtactcagctctgctgttgtagagcgaaagcagtcataggcaatatataaacaaacgagcatggccatgctccaataaacttaatttgtaaaaacaggtggctgtgaggccatagtttgccagctactcatctaaatattgatacagaggattcagatattctaaagctatatttactgtttttggtagatgatgtcccccaacttttaacttatagttaataacccgtatagtaagaaacatctgtcatactatggtgtatgtttcttaaatttcttaattagttaaagaggataagaagtagcattgctaaaatctggtttttctttgtgtgctatatagaggattgggtctgagacatatcttcagttatacctgttttttcatgctaatgtttcacccaattatggaacacaaatatgaaccttgatgatgtataactgtccattgactggactcagaatcgttttgaaaagagaatcttggccagaatattcctttgactcacctttgagcagagatcatatgacttcctattcaaatatgtaatcttgttgggatccttagttttttcaagagaatatcactttactctcagctcaaaagactagttaaaacatgtggttcacttttaataggcagtccatactgccaattaaagttgcacttgttatttcaaacccaccgcttcccaaaatcttgcagaagcttagctgaaatactatgtagtattgcctggaggatgtccagcttgtttctttctctaaatgttctaaagtaggttaacctagaggagcaaaagctgtcaatgtatctagtctaaatggtattcactccctgtagggtagcttttactgaatggctctttgtttcgtgatgcctgccatctgtactaaggaaggaacaataagaaacagccctctgaaacatatttctcttgaaaggatgttgttgatgacactgttaattgcctttgcattttctttatgaaatctttgaagaaatttcattgtaatcttgttaataattcagtaacaataaatgataattatgcttcctttgaggaattaatttttattttcttacagacatgatgattttatctaactgatcaaattttttatttcacattgaccattagaaaacttaaagctaaatttatgacctacccatagcaactttctagaattctattttataatagccatcaggcttggcccaatattttacctgttaccattgttgttcatatttccttatagttcatttcatcatcctgtattttatttatctttgtaagccatttaaccacttaggccttttttgaaacaaggcttaagtaagtttaaaatcagtaaatacaaaggacaccatcaagaaagtgaaccaacattccaaaaacaagagaaaatttttataaattacctatctgataatggactgggactcgtatctagaatatataaagaattcttacagtttaataatataatacaattaaaaaatgaataaaggatctgaataggcatttctccaaagatgatatacaaatggccagtaagcacatatgaatagatgcccaataccattagccatcaaggaaatgcaaatcaaaaccacaatgagataccacttcacaccaactaaaatggctataaccaaaaaaaaaacagaaaataacaagtgttggcgaggctgaggagaaactggaactctcatacactcctgaggaaaatgtaaaatgatgcagccacattgggaaacagtgggagtgcctaaaagattaaatatagatttatcatatgacccaacaattccactccatttctacctaaagagaaatgaaaacatacgtccacaccaaaatgtatacacacacattcctagcgtctctatttataatagctaaaaacaatccaaatgtcctcaattaatgaatgcagaaacaaaatataatatatccatataatgggatgaatattgttcaaccataaaaggaattattgatagatactacaacatggatgaaccttgcaaacattatggtaagtaaaagaagccagtcacaaaagattacatattggtggtttcctagaaacagaaagtatattggtggtttcctagagctgaggagattggggagaaacagggagtgactgctaatgggtacagggtttctttatggcgtaatgaaaatgttctaaaattgatttaggtgatggttgcacaactcttgagtatacaaaaaccattgaattgtacactttaaatgggtaaattatatctcattaaaactgttataaaaagtgctaacaaaaagttttaataaatgaagtacatcttataaactaataaaagtaattcatgcaaatcaggtgtttatatcaagagtacaaaagaaatatttttgagtataacatatattactgttaacatttattttcctttaattcttacattggaatgagattcctaggggtgggtaaaacaatagtcattctaccagcaatggcatatgttgatacatgttaatggtatatgttgcctatgaatatatcaaaaacataaacattcttattttaatatatgaaattcttaagatgttaagatggtcatacatacctttcaaaaatttgtattttttaatctctacaaatgagtagattttaagagcctagtaggctgattagataggatatattcaatattgagtccaagagcaaaaggaccctttggaagactaaagagaaagaaagttgctgccctctcttcctcccagtgacagtctttgacatttatttcagctcccgttattttcactggaaaatgaacctgtgtgtaattctgctgatcctggttttcatggtgcctttttacattggctattttattgtgagcaatatccgactacgtaagtattttaccctctcagtcagcgtatagattgagatgagtatttgaggggacttaaattgtggatagcttcatttctacattaactttcagtatctaccgctatttgaggatacctcacacacaacatcttaaaaataaatataaaataaatattgaatgaattggcacaaaataaatattgaatgaatgattaggttatttgttctgccacagctttatttttctacctattaataatgtctccgttagttcatcccacaccttaaattcagctaaatttctcttacgatggtaaggatgctttcactaaaaattatgctgttcatcagtcatttgccaagtgaattagcagccaaatattagttagcattatcttatatttttaaatagagcaagctctttaacctatatctgtttttcctaacagttttgtctcctctgtctcagtgcataaacaacgactgcttttttcctgtctcttatggctgacctttatgtatttcttctggaaactaggagatccctttcccattctcagcccaaaacatggtgagtatatataggagggcagaggaagtggggggagaagatttgtttaattttctgatttcaaaaacaattaattaaatttcttggggaaaaaatgtatttggggaaataatttattaattcacaggttcttgggatttggaaaaaaatttttctgattgaggaggatagcaagctatttctctgaaaaatgtctgattttgaaccacattttctccttcattctaagagataactaatgctggttttggacctcacttctatcattctagagtaggaatttttgaccttcatttactgaatatacttaaagggtataaggaaagagaacggtgtctaactcatattgtatatggaactacaggaatatatttgtatgtgtatttggaggtaaggtatcaataaacttttatcagatttgggtagcagatttgggtctgtgacccaaaaggtaaacggccactgcttaagtgatgataaagatacattagggaagcatatgtatttgaggaaaggtgacataaaacacccacaattagtagataaagaaaagctttccaagaatcggtgtctcccctctaacaaaaaaagtttattttaaaacaagaaatttggcagagccctaatttttaagctaaaaacaatgaacaaaagtacctcagctaacaagtccttccagaactatttcagaagtatgtatgaatctatctaaaaagattagagaatctatctaaaaagattagagagcccatctgtaataaatatactacaggtttcatgctggaacctttttaaaaatatatatatatatacctctttattcaccatcctgccgtacctattattaggcttcttattgcagaaaacagaatctactgtaactaatttaaagcagaaagtgattaattatacagtatcaggcaatttatagactttctaggaaagtagggatgcaaagcttaactgctatatagtgaagagaaatacccaactatgccacaatactaaactagaaaacctcactgaagttatcacctgccactcagggtctatgacatcagggacctcagtcccagctgtttgagctcctaagtgctatcaccacccctacattgttcatttctgcatctgaggcctcacatgggccgggttttttggtgaaacctaggtaatatttaaaaccttggcctcaaggaagtctgagaaggggcttttggctttctaaactctgtagtaccaaaacaaatgctggaaaaggatattggaattaatgttgaatgagccagtgtctattatagaatctgccatacctcccacacacccttccatgtatactgattgcctatagcaggaatttcgagagagagaggttatgagactctcctgcagtaagatcagaggagatatgcagttttgaaaagcatatgcaataccataaatagttgtgtatttttaaaataagaataactttcaaaatttcaaataacattaaaggccggaaaacttaacataacaccagcctgccaaaagcattcaaactcttaggtggcgtatgagacctttcatgacctggctgctgctctctatacatgttgcattctccagtcctgtgaaattatttcaagtttcttttttttttttctttttgagacaggtctcactctcacccaggctggagtgcagtggcatgatcttggctcactgcaacctccgactcccaggctcaagtgatcctcctacctcagcctcctgagtaacggggactatgggcgcatgccaccatacccggctaattttggtattttttcatagagatggggtttctccacgttgctcaggatggtctcgaactcctgagctcaggggatcgacccacctcagcttcccaaagtgctgggattacaagtatgagccaccacacccagcctcaagtttctagagctgttctatcagcctggacaatccttcaccaaccctgtctacctagaaaatgcctatttatcctttctagattcaactcttgtcaattcctttaggaagattttcctggccatcattaggagatattaattgctaccatctcaaggtatctatatcatctataaaacttaaaatttcatgtttccttttctaacttcctcatcaacctatgggctccctgaggtcagaaaactgcatgttatttgtctttgtatccctagtgcctagtgtggaaactgacacataacaagtgtttaatacgtgttctttgaatcagtggatggaagaaaattgagtctctccaaagtggtagatgagtttactactttaacactctggataggaatttaggaaatgctaatgtgatcagcatgcctatgtcaatggtcaacgaagggaacgacttgcactaaagagtcctggtagtatagttctcatataaacctatttcaaagaaacccacagacagacacatttatctgtgatggtagaagtcagagagaagagttagaaaaggcccccagggctgctgacagggcaaatacagtctcacatgcactacaaagacccgactctgacacctttctccagctttctcctgtgtgcattcagctcacatgaccagtgcagccaggctgcaccagagggaagatgaaggccattgtatctattgtcctttcatccacccctttttctaaattctatgggattaccctgaaaaggacactgagggagaaagctagggagatagtttcagttttattctttccattgtactccaataggcattacagttttatgcctgaatgttcaggtatcttaatttatttaaccctctaagataagtaaggaggaagaaaagtttaggtagtagctgagaagcaaccagccttacactgccttcttagagctttcccaggactgtcccaacaaccagtatggttgtttattgctgtggtgaccacaaaaaaatgggctgggcaggttggctcacccctataatcccagcactttgggaggccaaggcagggatatcacttgaggccaggagttagagaccagcctggccaacatggcaaaaccccgtctgtactaaaaatagaaaaattagccaggcatggtggtgcatgcctgtaatcccagctactccccggaggccggagacacaagaattgcttaaacccaggaggctgaggttgcagtgagctgagatcgtgccactcccctccagcctgggcgacagagcgagactctcaaaaaaaaaaaaaaaaagataagaccaatccttatgtaaaatgaaaaaaaaaaatctgtaaaagtacttcttgtgctgtgtctgaaccaaccttggaatgtccttagtgggaaagagtaagagagattacaaaagactgtaaggaatctgtgtgagcaggtggcaaaggtgagatgatcttctgctagtctccttattcatctgactttccatgtattaactgctaaatggggataatgatgactgactcctacttcatagaaatgctgagattaagtaaatagtatctacaaagtactttaaaccagaaaaagatatgtaataaaaggacaaagacaccatgttaaaaggaataaaggtagagggggaattttttcagtttttcaaatttaataacccatattaatctcttggattttttatgttactgagtgatattatagtcaacaaacatttgttgaacacctcatatgtgccaagcagtaaggaaaacaaagatcaataagaaatgatgtcttcttgtaaaggggttgcaaattcaagaggtatacggcaagtagaataacagaatttaggtgaggatttattcgttcatttagcattacacaaatatttattgagcatccactttatataaattaagcactggaaataaaccacaaacggaacaaacttggtttctgcccccctgaaatttatagtcttgtgggtggaactagacaataaagaggtaaatatataaataaataattgccaattgtgatcattgtcatcaaggagtgaacaggttgctgtgatagagaaaaatgccgataatgtagtgcaaacagttagatccaccctttctgagacagggatatttaagctgagatttaaaggacaagaccaaaggaagacccagcaagaaggcacaagagacatcatgtaaagccctgaggcagaaagaccttggtgtattcaaggaaaggcaagagatagaatggaaagtaatcgtatagtgtatagattttattgttagggtgattatgtcattttctaagacaggtaatgcagaggaaggaacaagttgaggggaaagataattttagtttggtatatgctgaatttgagttacttatgcatatccaggtgatgttaaataagcaattggatgtacaaatcaggagcttagggaaaaggtgtacatgtatcagtcctcatagagatgactccaggaatctaaacaactagaaatcatcaactaaatgccattaggtgaagctggggaaattggtgagatcacctaagcaaaaaatgtgtatcctgaaatgaaagtgagaactctggtccagacagagcaagaagtgaccaagaaaaagcaattagagaagtaaaagggaaaacatagggaaatggtgttgtggaagccaagaagataaaataattttttttttttttttttttttaattgatcattcttgggtgtttctcacagagggggatttggcagggtcataggacaatagtggagggagggtcagcagataaacaagtgaacaaaggtctctggttttcctatgcagaggaccctgcggccttccgcagtgtttgtgtccctgggtccttgagattagggagtggtgatgactcttaacgagcatgctgccttcaagcatctgtttaacaaagcacatcttgcaccaccattaatccatttaaccctgagtggacacagcacatgtttcagagagcacagggttgggggtagggtcaccgatcaacaggatcacaaggcagaagaatttttcttagtacagaacaaaatgaaaagtctcccgggtctacctctttccacacagacatggcaaccatccgatttctcaatcctttccccgcctttcccccctttccattccacaaaaccgccattgtcatcatggcccggtctcaatgagctgttgggtacacctcccagacagggtggtggctgggcagaggggctcctcacttcccagtaggggcggccgggcagaggtgcccctcacctcccagaccgggtggctggctgggcggggggctgacccccccacctccctcccggacggggcggctggccgggtggggggctgacccccccacctccttcccggacggggcggctggctgggcagaggggctcctcacttcccagtaggggcggccgggcagaggcgtccctcacctcccggacggggcggctggccgggccaggggctgaccccccacctccctcccggacggggcggctggccgggcagaggggctcctcacttcccagtaggggcggccgggcagaggcgcccctcacctcccggacggggcggctggccgggcggggggctgacccccccacctccctccaggaccgggcagctgacggggcggggggctgacccccccacctccctcccggatggggcggctggccgggcggggggctgacccccccacctccttcgcggacggggcagctggccgggcagaggggatcctcacttcccagtaggggcagccgggcagaggcgcccctcacctcccggagagacggctggccgggcagggggctgaccccccgacctccctcccggacggggcagcttgccgggcagaggggctcctcacttcccagtaggggcggccgggcagaggcgcccctcacctcccggacggggcggctggccgggcggggggctgacccccccacctccctcccggacggtgcggctggccgggtgtggggctgacccccccacctccctcccggacggggcggctggccgggcggggggctgacctccccacctccctcccggacggggcggctggccgtgcggggggctgatccccccacctccctcccggacggggtggctgccgggcagagacgctcctcacttcccagacggggtggctgccgggcggaggggctcctcacttctcatatggggcggttgccaggcggagggtctcctcacttctcagacggggcggctgggcagagacgctcctcacctcccagacagggtcgcggccgggtagaggtgctcctcacatcccagacggggcggcggggcagaggcgctccccacatcttagacgatgggcggccgggcagagacgctcctcacttcctagatgggatggcggccgggaagaggcgctcctcacttcctagatggtatggcggccgggcagagacgctcctcactttccagactgggtagccaggcagaggggctcctcacgtcccagacgatgggcggccaggcagagacgctcctcacttcccagacggggtggcgccgggcagaggctgcaatcttggcactttgggaggccaaggcaggcggctgggaggtggaggttgtagtgagccgagatcacgccgctgcactccagcctgggcaccattgagcactgagtgaaccagactccgtctgcaatcccggcacctcgggaggccgaggctggcggatcactcgcagttcggagctggagaccagcccggccaacacagtgaaaccccgtctccaccaaaaaaatacgaaaaccagtcaggcgtggtggcgcacgcctgcaatcgcaggcactcggcaggctgaggcaggagaatcaggcagggaggctgcagtgagccgagatggcagcagtacagtccagcttcggctcagcatcagtgggagaccgtggaaagagagggagagggagaccgtggggagagggagatgggggagagggagagggagagggagagcgataaaataattttaaacaaaaatgattcaatgtcataaaagagccaatgaaacaaggattggaaaatgttgaattttgcaaccaggggaaaacttattaccatagtgtcgtagtggttaaagcccagactctggagctagactgcacttgaatcctgactctgccccttttatctgtgtggccttaactaagttacttaacctctctgtgcctccatttcttcatctgtaaaattaggttttcaataatatctacctcataggattgttatgagggttaaatgaattagaacatgtgaaatgcttagaacagtgcctagtcatagcaggtgcttggtgaatattacctattatattgccattacaattactagtgaaagtaatttcattcaataaagaagaatgggaagaaagctggattgcagtcagttaaggaatgaactggaggtgaagaaaaagtgacaataactataaacttcttttaagaagcctgtctattaaggaggaaatagatgggggttggtaactagacgtaaactcgaagccaagaacagaatttctcttagaaaagagaattgaaactaaagagaaagaactagcaaagaaggaaatattgaatatacaagagagaggagacagatgatggaacaagactctgaaagaggtggaagggattgaatacaatcaaaagtatggtgacttctagttccaagatggtggcgtaggggcaagctggctttgcttacccccctggcagaaaaccaaaaacaaatagcaccaagattatcactagcaatatcccagaactcacatataaggatgagacagttcccagggcccagagaagatcagaagcacaagtggagaagttagctttggatgctactttgttctaagggagacaagttgggaggatgattgcagatgtatattcaatgttataaaacagcccataaaacaaagattggaaaatgttgaattttgcaaccaggagaaaattcatgaccatagtgtagagtgaaggtagtttgtagtagagtgaaggtagtttatggctaatagctatgtcttttataataaggacattggcaaaggagaaggacaaaggtaggaaaaataaagagtaactgccaaaggcaatggagagagatggctgaccaagggcaagataaggattagtcaatagtgtgagagctctcttaggtctggagaccatacatttgtaatggctccaaaatcagtatgcattctagcaatttgaggcagcaaaacatgggcacagggaaggcagagtgttagactgatccagagttgggaatttgtaggattagcgcttcagaaggaagatagtaggagattgaggctcctggtgagagaatttgaagccagcaagcctggagtccaagctaggtgaagaatggagaagcagaagaccagaggttgcactgacctctaaaacgagtgtagtggaaatagaaagactaggaatggaggccagtagtcagaaaaggaatattggaattttcagttttgaagctgacagaattcctgaattatatagctctggcatttgaccataggagtggatggctgtagtgaattctatcctagaaatagaaagtgaaaaccaattaaaaccattctttttctgcaatgccaaacttactgagttattcttcagcattggctttctctcatttatcccaaatacatcaaccagcagtatttattttaactgctaagttgattttcagcattctcacgtgatatgaaacaattgataattaggatacaatttataatccgaaactgatgtgtttgcctttgaattactcattcatctataagtttagtccttttattagatgaattctgtgtttattggatgcaaaaaagaataagacaaaagcaaaagagtatcaccttaggggaaatacatatatatcaaagataattagcacaaagtagttcctgctatttatacttttccagcagatttactttcttagtttttttttttttttggccgatgcttttactaaaagtactttgctttgttagcattcatgctaccaagagtaaacagtcaatgattgttatttataattattgttgttattattttactgctatcacccaataaaagagatcactctgaagcatatgggacaggaggaaaatcagtaaacttttagtatatttattataaataatctacacattaataattaaaagttggcttgtatgagttagttatgtgtaatggttaatgttttaaataatgtttccttttgcagtacagatgagagccattttgtctatattacctggcattaatgtgccttgatgtttttagggatcttatccatagaacagctcatcagccgggttggtgtgattggagtgactctcatggctcttctttctggatttggtgctgtcaactgcccatacacttacatgtcttacttcctcaggtaacagagcgctttgcatcctttcttttttgccccattacttcttgaatacatatgtcatattatgccaccatctttaagattatatattagatctatgacactgtctttttattcttctcttcctctgtccctgtgggcattgacctggaaatctttctaaataagtattatcacttgtacggcttgcctttattatttgtcctacattcatttattttttaaatggcaaatttcaatctgacactcccctcccacttttttaaaggcacatttctagtgaccagcagtataaaccaactccaacttcagcagttcagctcccctcctagatattaacagaacagtagaagacaatgccaagttaaaagtgtgcttaaacatacatcctaaatgtcactgagctgagatcatgccactgcactccagcctcggcgacagagctagactctttcataaataaatgacgggttgatgggtgcagcaaaccatcatggcacgtgtatacctatgtaacaaacctgcatgttctacacatgtatcccagaacttaaagtataataaaaaataaaataaaaatatttaaatatatattttatatatatatataaatgtaactggatcaaagctaagaaaaactgtaagagagctgggtgaattccatttccctgagatcccagaggattagctataagaaatgagagcaaaggcattttagtttattatggtcattttactattttctagaaaaaagtagtaggtaacagttgaagtctatgtttgtctccagataccctgtatcatgcccaagagtgggaccccaaaacattttgctagcagtttgtgctttttgtaggaatgtgactgacacggatattctagccctggaacggcgactgctgcaaaccatggatatgatcataagcaaaaagaaaaggtaagatatcaacactgtaatacatttggactcttacaatttctcaacaagaaaatttgactgtgaattggtgctggcagggaattttatcttattcatttttactataaggtaaagtaccagatttagtgttggctggacacagtggctcacacctgtgatcccagcactttgggaggccacgacggggggatcatttgagcccagaagttcgagactagcctgggtaacatagtgagaccccacccctttaaaataacaataaaattaaaaatataaaaaatttttttaaaaagatttagtgttttgtgtgaaagaaaattcaatctcatttcttgaatttagatcattctccttagataaattattagaatttttttgtttaattttttaaattgtaaattgacaaattatggttgtatatatttgtggcatacaaagtggaataattaaatcaagctaattaacatgtctgtcacctcacatgtttatttttttgtggtgaaaacatttgaaatttactctcagtgattttgaaatgtgcaatacattattatttattacattcatcatgctgtacagtatgttgcaaagaaaaaaaaccttattcctccttgtctaactgaagctttgtaccctttgaccatcatctctccattcctcccacccatccagcctctggtaaccatcattctaccctctgcttctgttgagttcactgttttagattccacatataagtgagaacatgcagtatttgtctttctgtgtccaactcattttgctagcatagtgctctccagttatattcaagttgtcacaaatgaaagaatttccttccttaaggctgaatagtattctgttgtacatgtatgccatattttctttatccatttttctgttgctgcacatatagattgataccataacttggctgttgtaaataatactgcagtgaacataggtgtacagatatctctttgacattttactgatttcagatcttttgggtaaatactaagaagtgggattgctggatcatatggcaattccattttcagtttttttgggaacctccacactattttccatagggttgtgctaatttatatttccacaaacaatgtaatagggtttccttttctcagcatccacaccaatgttctttatcttttgcccctttgatagtagtcattccgacaggtatgaggtgatatctcattgtgtcttagtttgcaattccttaatggctagtatgttaaacattgtttgatatatctgttggtcatgtgtatgccttcttttgagaaatgtctattcaggttccttgcccatttaaaaatcaggttatttgttttctttctgtagaattgtttgaggtccttatgtattttgtatactaaccccttatcagacatatggcttgcagatattttctcccagtccataggttgtctcttcactctgttaattgttttctttgttgtgcagaagctttttattttgatgtaatcccatttgtctatttttgctttaattgcctgcactttgggggttaaatctaaaaagttattgctcagagcatgatttgtgtagtttttccctgttttcttctagttttatagtttccaggcttaagtctttagtccattttgagttaatctttatatattaagtgagagaagggtccaaattcattcttctgcagatggatattcagttttcccatcaccgtttagtgaaaagaccgtccttttcgcagtgtgtacatgtggcacccttgtcaaaaatcaattgaccatacatgtgtgggtttatttctgggttctttattctgttcccttggtcaatgagtttgtgcttatgcttgtatcatgctgttttaattactattgctttgtagtataatatgaaataagatagtatgatgcctccagctttgttcttttattcatgattgccttggcaattcagttttttgtggttccatatgtattttaggattattttttctatttctatgaaaaatgacgttggaattttgatagggattacattaaatctatagattgctttaggtagtatggatgttttaacaatactaatgttcaatgaacattccaaaaatgaaatcaagagaaccatcccacttaaaatagctacaagaaaaaatacttagggataaatttgaccaagggggaagaaagacctggacactgaaaactatacaacattaatagaagaaattgaagacgacacaaataaatggaaagatatcccatgttcatggactggtgtataatttttgtattcaaagaatggaatattgtctattgtgattttttttttttttaagacggagtctcactctgttgcccaggctggagtgcagtgacgtgatttcagctcactgcagcctccacctcccagattcaagcaattctcctgcctcagcctcccgagtatctgggattataggtgcgcaccaccacacccagcttatttttgtatttttggtagagacggggtttcaccatgttggaccaggctggtctcaaactcttgacctcaagtgatctgcccaccttggcctcccaaagtgctgggattacaggcgtgagccaccatgcccagccttattgtcctgaatttttttaagtctattttccttaattttttacaatcttttacatatctgacttagatctcaacttccttcgttccaactacttaaaatcatttaagtcctctatatcatctttgttatttaaaaagtacttttaaaatgtgtattttcaaggtgggatttcatagaaatctatatcacagtgtataaaagcataggctctgaaatcagactgtgtatgaatttgaatccttgatctacaacttaatggtgtgaccttgaactagttactttatgtctttgtgcctcatttgtaaaatagaggtaataataatgagttaagacttagaaaaacaagttagagcccttagaacaatgacccacatatagctaaggacaactactgaaattattaatagtctctacagtacaatcatttgcttttcatgctttgccttcatttattcattcatagattcattcacttaataattttagaaaacctagtttacgccagacactgtactagatgctagggatagaatgatgaacaagataatcatttcttaccttcatgaagcttattagtctactctctttattaaagttattattacccataagtaaatggtaacaggttttgaattgcatgagtattttcacatttcatatttccttcttcaacacttttctatagtaagacccatagtcaagttaaagaagccttaatgtaagagataacattagacataaaggccaggcgcagtggctcacgcctgtaatcccagcactttgggaggccgagtcgggcagatcacaaggtcaggagatcaagaccatcctggctaatacggtgaaaccccatctctactaaagatacaaaaaagtagccgggcgtggtggtgggcgcctgtagtcccagctactcgggagactgaggcaggagaacggtgtgaacccaggaggcggagcttgcggtaagcccacatcgcgccactgcactccagcctgggtgatggagtgagactccgtctcaaaaaagaaaaaaaaaaagaatgataaagaaggctcaggttcactgactaattatttgtctctatttctgcatgtcagtaaagacagtcagtaaagactaggctattgaaggtagacacgtgtataatttattttatttacatttattgtttattttacatgagtgtatataaatgcagattttaaaaaatagagcaagattattcaaaagtgaaagatttatataaacaatactattttgattcccaaggctattctctttctcactgtatttcttttattcatataaagaaatgaatatataaaagtgaagtcatgaccgggtactcatgcctgtaaccctaacgctttgagaggctgaggtcatgagttcaagaccagcctggccaacatggcaaaaccccatctctagtaaaaatacaaaaattatctgggcatagtggtgcatgcctgtaatcccagctactttgggaggctgaggcaggaaaatcgcttgaacccgggaggcagaggttgcagtgagccgagattacaccactgcactccagcctgggggcagaacgagactctgtctcaaaaaaaaaaaaaagtgaagtcatgacccatgtcaagtgtggatacatacttttaagccatttcatactaatagtgctaaggaattgactctgatctgtacatactatagcccatttcccctataatgcattgtctggtcaggatcaggaatggtttgtggtccgacagtaagttttattaatttgagtggctcacagaagaatcagcctcccagcatgaccccattaccacagtcctttacccagtggaactaacagagcagatagacagcaaacatgacaacactggggcccttgggattcatataatgcccttgccatttaccacaatatagaaaaactgtttttgttgtttacaagtggttttacaaaataaaattttttttaataaaaaagaaaaactgtttttgcaaacattcatagttggggaggagtagtgaccagaaaaccatctttcaccttaacagtagagggccatagtgagatgacatacaagaaaagtaacatttgttatgtacaaaaaagttaatggtttaaaatgggaggaggaaagaggcatacgtcttcctgtttggaacagtgagggaaaaaatgttaacctctaccttgaattagttttctaggacctctttgaaattttgtagagataggaggaagaaatatattcactagtgaaatttcagcaacagccacagccattctcaatagaggaaacttccagaaatgacagtggaaagaatttaagcaattctttctacagaaaatcataaaaactggaaaaaatattaaaagcaagtatttgaagttactggaaaatgagcagaggcaggtagaaatttgagaagagcatcaggtaactattgcaagttgatagctttcttgcctggaagtgccccttagccaccacccaccctcccagcacccactcaagtgtacagattggtaagagtttaaatcagctgagtaactgaacatttaaaggggaaattttggaaatgagggaaatgcagaaggactgatatccaaaatctcagtataaacccttcccaaatctctgtgtcatcattaaataatgtatttccacggtaaacaccaaagagtctgagaaaaataggcagaaactagaagagagtctatccttgatatactgaactgcttcttggtgcgatttgcaaggttgctgtgcctttgattgagtgcattttctgagctatgtgcaggttgaacacacagtttggatgacagaaagtgaaagcttttctggcttgaggtgtcagagggtagatctcaggactggcaaagcagttgaaaatttaggagagatccctagaagcaaaagatccacagagaggataagccctaaaatatgactatagaatttgtccagactaccactaccctacacaagctcaagctcagcagagaatatcagggagttaggctaaaaaggagaagctagaaaccaagaaactgagcagaaacattagctgctgcaggtatgacagatttcacagtttaagtaaattaactgcttactagtgccaaaaaaattaacaattctcagaaaaacaaaacagattccaaagtcactacaacatattaccttcaaccaaaacttgctagacatgtaaagaaacaagacgatgtgaccaatgttcaagataaaaagcagccaatagatactaactccaagtggatccagattacacatttaacaaagacttgaaagtaaccattacaaatatattcaaaaaagtgaaggaaagcatgatacaagtgaaaagagaatcccaacaaagaaatggaaacttttaaaaaacaacaaaatagaaatccaaagactgaaaactacagtaacggaaataaaaattttactaggtgggcttaacaggagaattgagatgacagaagaatcagatccataaaaattcaggctgggcatggtggctcacgcctgtaatcccagcactttgggaggccgaggtggttggacacctgagatcaggagttagagaccagcctggccaacatagtgaaaccctgtctctaccaaaaatacaaaacttagctggccatgctttcacgtgcctgtagtgccagctacttgggaagctgaggtaggagaatcacttgaacccaggaggcaaggttgtagtgagctgagatcatgccactgcactccagcttgggtgacagagcgagactgtctcaaaacataaaataaaaataaaaattgagatagattaatagaaattatttaatctgaagaatagataaaagattgaagaaaaatggccaggtaatcccagcactttgggaggccaaggcaggcggatcacttgaggcctggccaacatggcgaaaccccgtctctaccaaaaatacaaaaaaaattagctgggcgtggtggtgggaacctgtagtcccagctactcaggagatggaggcaggagaatggcttgaacctgggaggcggaagttgcagtgagctgcagtcacgcctctgcaccccaccccaggtgacagagcgagactctgtctcaaaaagaagaaaaaaatagtaaatatttttttaaaaaaagattgaagaaaactcaacaaaagtctcagtaggagacaatatcaagcagtccaacattcttgtgattggagttctaaagaaaaggaaaggggcagaaaaagcattgaaagaaataccagcccaaaacataagaaaactacacctatgtgtatatatagtgaaactgctaaaaggcaaaagtaaagagaaaatcttgaaagcaacaaggggaaaatgatacatacagggcaacaatgggaaaaaaaaaagtaatggttattcaacaacattgtagaataccaaatgaacatacaaaaatcagttgtagccaggagcagtggtgaatgcgcttgaccagctactcaagaggctaaagcgagaggattgtttgagcccaggagtttgagtgcagcctgagagcaacgtaacaagaccccatcttgaaaatccaatttttttaaatcaattgtctttctataagctagcaacggacatatgaacatcaaatgtttaaatacactacttacaatcactcacaaaatgaaatacatagaagtctaacaaaacatgtatataggacttgtttgctgaaaattataaaactaatgaaaaaatcaaataagatataaataaaccatgttaatagattggaagacttgaatagtaatgatgttaattctccccaaattggtatacaaatttaatgttattcatttcaaaatcccagcaagatttatttgtagatatacacaaaattattctaaaatttgtacagaaaggcaaaataactagaatagttaatacaatttttaaaaagaacagtatgagaggaattcctctacctgatctttaaacatattatatagctgcagtaatcaagactgtggtactggtagacatagatcactggaacagaaaagagaacccagaaataccgacacatggccaggcacggtggctcacgtctgtaatcccagcactttgggaggctgaggcaggtagatcacctgaggtcaggagtttgagaccatcctgaccaatatggcgaaaccccgtctctactaaaaatacaaaaattagctggacatggtggcatgcgcctgtagtcccagctacttgggaggttgagacagaagaattgcttgaatccaggaggcagaggttgcagtgagctgagattgctccgctgccctccagcctgggtgacagagccaaactctgtctcaaaaaaaaaaaaaaaagaaaagaaaagaaatactgacacaaatacacccagctaatttttgacaaagatgcaaaagcagttcagtggaggaaagataacctttcaccaaatggtgctagagcaattaggcgtccataggtttaaaaaatgaatctaaatctaagtcttacaccttatataaaattaaaacacgccaggcgcggtggctcatgcctgtaatcccagcactttgggaagccaaggcggacggatcacttaaggtcaggagttcaagactagaccggtgaacatggtgaaaccctgtctctactaaaaatacaaaaaattagcccggtgtggtggcgggcacctgtaatcccagctactggggaggctgaggcaggagaattgctgaacccaggaggtggaggttgcagtgagccgagatccgccattgccctccagcctgggcaacagagcgagactccgtctcaaaaaaaaaaaaattaaaacagataatagactaaaatgtaaaactataaaactttcagaaaaaaaaaaaagaatctttggaatcaagggctacacaaaaagttctttacttgataccaaaaataaaatccatgaaaggaaaaaatggataaattgggctccatcaaaatttaacactttcgctctgtaaaagactgttaaggcccggtgcggtggctcacgcctgtaatcccagcactttgggaggccagggtgggtggatcacaaggtcaggagttcatgaccagcctggccaagatggtgaaaccccgtctctactaaaaatacaataattagccaggcgtggtggcgggcacctgtaatcccaactactcgggaggctgaggcaggaaaatggcttgaacctgggaggcggaggttgcagtgagccaagatggagccactgtactctagcctgggtgacagagcaagactccttcttaaaaaaaaaaaaaaaaaatactgttaagaggatgaaaagataagctacccactgggagaaaatatttgcaagccacttatttgagaaagcactagtatctagaataaaaaacattcaaagcttacatttaaaaaaaatgcagttagaaaataagcaaaaatgatgaacattttattgtagaggatatacaaatggcacataaccacatgaaaaggtgttcaacattgttagccattatggacatgccattaaaactacatcgagataatcactacacacctatcagaatagctaaaataaaaattagtgacaacaccaaatactaataagaatgcagagcaactggatcactcatacattgctggcatccatgtagaatggtacagtccctctggaacacagtttagctctttctttaaaagctaaacatgccgttaccacaccccaacaattgcactcctgggcatttatccagagaaatgaagatttatattcacacaaaaaactgtacttgaatgtttatgaaaattacgctgagtgaaaaagaatccccaaagaatatataccgtatgattctagttatatatacatttttgaaatgataaaattacagaaatggagaacagattcgtggttgccggaattaaggaattggaggtgggagggaggtaagctgtacaggtgcaccctgaaagatccttgtagtgatggaaatgtcccgtattgtgactctatcaatgtcagtatcctggttgtactagagttttgcaagatatttcagttgaggaaatctgggtaaagggtacatggaatctctgtattttttctcaaaactacattatgaatctacaattatttcaaaaagtttaactaaaaaaaagtaatggctgacttcctactagaaacaacagagaccagaaaatagttgactgacatttaaacctcagtagacattttttagcttcttctgttgtacactactaccaaacctcagccaagtgcatatgtttttccatattaggaacttttaaatgacattgggctaataacaaatagataattccttgtaagctacccttgttataaagaggcaatagtgatgatgatagtaaagaaaagttgaagatgaaggtgatctaattctatagtacctcatatggttgggtggttttttcattcctattcacgcttcggaaggtttaatattgttaccttcttaaatatataatcatttctttttcatctacaacttatttgataagagcaaaattggtttagaattaatagattcttgatacaattgaaagtaaaagtgaattgtttaaaacaaggccatgcttgtctatgtgcctctaactttcacttctagtgattacacttctttgcctattatgagaccacagcacagtgtcaatcacctttacatattcaatcgattccactccacagccagtcattagtgtttgttgtagacactgaaaataaggacaatagaaatgagctctgtgcttcctctctcacaactgcctcttttaatcctgcatgttaagctgaaatgaactattaaatgagtggaatagaacccttgccttctttgtgtatgtgttctagctttttcaactatgaaaatataaaaacctagaattactaagccttaatcttacaagtcagaatctccctaggtctgagcctcttcttggttgtttattacatcttcccaaaatggtgagtgatagtagatgtgtagttagaagaaaggcagaaagagctaaaagagctgtgtttcattcactcagtatccaggcaaaggtcattttcaaaaggaaacagttaagtcaacatggctgacattctttcctgttaatatcattttagctaatggctcaaaaaatttcacccatagaaatatcatttgatctttggtaccattgctactatttgtattagtcccaggcataaataccaatgctgctgcttgctcttcaccatttttatcttttgcctcccaaaaatatccaccttgagttacatttttctttggtcctgctactctatttttattagactcatcctagttcattttatgcctgtaggccttggcccattaaaccctttaaatcaattatgtacaaatgatcttttattttgatcctcactaggaccctgttgatacctttgtggtgagctgggacatgccagcagctaccactgtactagtcggtcctccacagactgagaggaccaggagtggtaggtttcctgttgacttattcacctgtaggacagattacagaaggtgagggtattggacttagagactgatattttagaaggggacaggtttatgcaattttgctatttttttttccttttgtctgcctttgaaaaagaaggaagaaaacatgtattgcgttccaaactctgtatttggtcctttagttaggtatgttagctgtttttttttgtttgtttgtttttgttttgtttttgagatggagtctcactctgtcacctgggctggcgtgcagtggcgtgatctcagctcactgcaacctctgcctcctaggttcaagcgattctcctgcctcagcctcccaagtagctgggattacagacatgggtcaccacgcccagctaatttttgtatttttagtagagatggggtttcaccatgttgcccatgctggtcttgaactcccaacctcaggtgatccacctgcctcggcctcccaaagtgctgggattacaggagtgagccaccatacccagccaggtatgttagctgttttattttgtctttaaatggtaactgtagtaattaaactatgtatagcgccttgtagttgacaacatgaattcatatgtattatttcatttatcttcacaaccatccagatatgaggagatgaaaactctaagacctcccagcttccaaatagcagagccagtcctcaaatttattgcctagcccaaattctgtgcttcttcacccaggccacattgcttccacatagtttcccttcagttgtaagtagtagaaaagtaggactccagaatcagtatccttacataaacagctcagtacatgagaggcagttgtgagactggaaaatggatgggactagactgtgagggtccatgcttgcttgctgaggctttatattttctttcatttcaggatggcaatggcacggagaacaatgttccagaagggggaagtgcataacaaaccatcaggtttctggggaatgataaaaagtgttaccacttcagcatcaggaagtgaaagtatcctttgtccctctgcttgattctttttctcaactctggaccaagagcaaaagaaaaaaagtagtgttgggatagtcccttctaaggtacctgactacatcagagtccaaactcctaagagctaggcttaggaaataccatgtgtacagtcatctttccagcacctgcacaatatcataaaatcattgtctttgagctgaagtggtcctaaaaagtcagcctttccattttacagatgagaaaatagacccagagaggttaagtcacacggtggtttgtggcaaagctagaaacataactgtggtctcctcttcatagttctttccactacactattacatttctcaactctgaaaaaccaccataaagcataatggctacctaaaataaatggcccatttctaaagtaattagtattcctaaacaaattttaagtagctctgcttctccagtgacattttggtttaaagaatcaaggggaggctgggcgcagtggctcatccctgtaatcccagcactttgcaaggccgaggtgggcagatcacttgaacccaggagttcaagacaagcctcggcaacatgacaaaacctcatctctacaaaaaatacaaaaattagccaggcccagtggcatgtgcctgtaatcccaactactcaggaggctgaggtgggaggattgtttgaacttgggaggctgaggtaggagtgagcccagatcacgccactgcactcctgcctaggcaacagagctagaccctgtctcaaaataaaaaagaaaggataaaggagatttgattaatagattaataaattgttctttcctgattggttatgatgttgaactacttcccaaattatgtaaccaaatttctgtgtggctctggtgctattaggtcaaaactttggggaactaagcatgagatagcatactcctgtttccttctctgtcccagggaaatacaaattcccttttgcctcaattagagaaggatgtctattcttgctacaaattatgatttatgtcctggtgtcaaatgaagataagaataagatcaaagaaaggcaagatgattgtggaagagaaagaaaaaggattaatttagatttatttaaccaagaaacatttattttgtatctcctatttccaggctgagtgctaagaaataaaatgatgagtagagtatagcctttctcctcaaggagcttaccctctaatcatgggagagacagacatgtaactagttaaaccatattgtttggtggcttgaaccatgccagtagtagccactattaaggaaggaactgaagggcacttactgatttgggtaatagtgggaaaaatcagagaggagggaggatttagattgaagtatgtgcttctattttagaaggggctatatttactatgtttattacttaaaagttcataaaagccaataatatgggtttgagctgtgttagtgatgagttaacaaacatatcaggactatttaacctccctgagcccctgttctctaaatgggagaataataactctacctgattgagttcttggaaaataacatagtgtaacggaaagagcaggctttggaggaaaagaggatttgactttgcatctctatcaattaattgtgtgactttgagcaagttatttaactctctgagcttcactttccttatgtgcaaaatggataacaccatggcataagacaatcccatgaagataagatataaaagaagataatgtttgaaaagaaataaggtaatgtctgtaaatcctagcctatattagaacacagtaaagtattagttcccttttctaacattatattcagataatgtaggagaaagctatgctttattatagttattattctgtaactatttacaatcttgaacattacatttgacttaatctaactagataaatcaaaaaacaaatgaaactatctgtttgagctgcttgacttaagagaaactgagtggtaattgtttggtggcgatgctcttgatggagaagcttttacacacctgcgtcagaggttgggaaagttgctctgaagtagtgttgctggctatgaaacaggaaattgagaatataggcaactccgggaatccactgtaggaaaaactaaaagtatatgctttctcattgccatttcttgaaattcctatgtgattaaaaccttgatgcccattctgtgccagatcttactcttattcaacaggaagtggatgctttggaagaattaagcaggcagctttttctggaaacagctgatctatatgctaccaaggtacagagcaaggaaactgaagtgtggtttttaccaatattattaaagagagaacaagactaaatggctttttagatttctctgtggccaagcaagagatacctcacagcttctatatcagccatgaagcattagggataagggatcttcactcttcatgaaattgctcctgtcactagcaaaatccttaatggaacactctcaaaagtagcaattggtgggatagtcagaagaggcttttcaacatttaggaaggtggcacgtaccacctcctactaacctgggataaagatggtagctactttttattcctttataagttagtaatattataagagcagtagacacctatctgccatggatggcctagccctattttaaaggatccagatcaataagtgtcgaaactgtaagaagtaactttcctatgtacacctaaaataaaatataatttaaatgtgcaaaatctgttagtgaagattgcaaacttttaattctttttgaggataactttacaggagtaaccttataggacagaggttaacataggctttggaaacagataaacctgagcctactcaccagctgtgtgactttgagcaagttatcgaacctctcaaagcctcaattttctcatctgtaaaattaagataatagaacgtatctcataagagttgttatgaagattaagtggataatgcatgtaagatgtttatcccagtctctagctaaaagcaagcattcagtaaatgctggccacaactactgttattagtttaatattattgcaatgtatggttttttgactgaacctgaacagtgattcatagagggaagaatacttgtgttgaatataaatttatattttgctgaaaactatgttttgtgtttgttttcccccaggagagaatagaatactccaaaaccttcaaggggaaatattttaattttcttggttactttttctctatttactgtgtttggaaaattttcatggtaagtatgttatttttaattatcagagtttagatgttttttcctggtagtggcagggagataagagtggatttgactgatatattgaactaaattccaaatgtgattgcatcaacagagagcatgatcttccacatctctgggcttcatttgttatcctctctcctttttagattacatagataaggaaggttgcatttttcttctgtcagaaattgttaataaggccttagtttatgaaatatctaaattgaggccgggcatggtggctcatgcctataatcccagcactttcggaggccaaggcaggcatatcacctgaggtcaggaattcgagaacagcctggccaacatggtgaaaccccatctctactaaaaatacaaaaattagctgggtgtggtggtgggctgcctgtaatcccagctactcaggaggctgaggcaggagaatcgcttgaacccgagaggcggacgttgcagtgagctaagatcacgccactgcactccagcctggggagagggtgagactccatctctctctctctctctctctctctctctctctctctctctctatctctctctctctctctctatctctctctctctctatatatatatagaatgtgaacatttcttattttgcattctgctttctgtgttacccatgagtacataactgtatatataacttcaacttctaccttcagctcagaagttacttgtcctttttaattatgtgtatacctaaaaaattaagttcacaataaattctaaaatgtatttccatagataaattcatttgctgtacatatagctctaattcttttgtggttttctcataatattttttatgtacagtatttgtctttacctctgactcaggtattaatggatttcaatgtgattacagaaaaggctgatttgacttcctagtttgatgactttcctactgggtttgtgtttgtgcacagaggagctttgtcagcttgttagttaattttgatcaatgtagatgaatgaggattttcattatataaaggatctagtgttacaataaattgatgtcaataatactcagatgacattttaaaatctggattcattcagtgggagataatgaatgaagatagtatgttcagttagcaaagctactaaaaggtattttcctaagatgcagcgtttagggaagcatgtctttttttttttagatggagtctcactctgtcacccaagctgtagtgcagtggtgcgatctcagctcactgcaacctctgcctcctgggctcaagcaattctcctgcctcagcctcccgagtggctgggattacaagcacgcaccgccacgcccagctaacttttttgtatttcagtagacatgggctttcaccatgttgcccaaggtggtttcgaactcctgagctcaggcaatctgcccgtctcagcctcccaaagtgctgggactacaggcgtgagccatcacacccggcctagggaagcatgtctttttttttttttttttttttttttgtgaagacggagtctctctctgtctcccaggctggagtgcagtggcatgatctcggctcactgcaacccctccgccttccagattcaagtgattcccctgccttaggctcccaagtagctgggactacaggtgtgtgccacaacgcaaaatacaataattttttgtatttttagtagagacagggtttcaccatcttggccaggatggtctcgatctcctgaccttgtgatgcgcctgcctcagcctcccaaagtgctgggattacaggcgtgagccactgcacccagccagcatgtcattttttaacaggcttgttggggtataactgatatgtaaaccgaacatatatttatgtacaactgggtacgttttgacatacatatatacctatgcaacaaccatcaccacggtcaagacagagaacacatccatccatcactgccatgagattcctgagattcctggtgtccctttgtaatgcctctctcccacacctctagtccccagacgactgccagtctgctttctctcattatatattagtttgtattttctagaatgttatgtaagtagaatcctacagtatgtatcctttttctgtctggcttattttactcggcatgattattttacattttatccatgttatgatttgtatcagtagtttattcttttgtattgctgagtagtgtttccgtggtttggacgtgccacaattttgtttgtccattcatctgatgatgaatatttggttgtttccagttgggggatattacagataaagttgctgtgaacacttgtgtacaattttttgtatagacgtgtgctgtctttctcttgagtaggcacttaggagtggaatgtctggatcatatggcagatgtaatgtttaacttttgaagaaacagccaactcttttccaaaaaaattgtatcatttacatttccacctgcactgtgtatgagtttcagttgttcacatcctcaccaacactctatatggccagtcttgctaatattagacattctaatagatacgaggtgatattgcattgtggttttaatttatatttcttaatgtctaatgatattgagcatcttttcatgtgctttttttcccacccatattttttttggatgaattatctgttcaaatcttttgccaatttttttttaaattttaagttctgaggtacatgtgcaggatgtgcaagtttgttacatatgtaagtatgtgccatggtgatttgctgcatctgtcaacccatcacctaggtattaagcccagcatccattagctatttccctgatgctctccctccccctccccgccttcgacaggtcccagtttgtgttgttccctccctgtgtctgtgtgttcacattgttcagttcccacttataagtgagaacatgtgatatttggttttctgttcctgtgttagtttgatgaggatgatggcttccagctccatccatgtccctgcaaaggacatgatctcattcctttttatggcagtatagtattccatggtgtatatgtaccacattttctttatccggtctatcattgatgggcatttgggttgattctatgtctttgctattgtgaatagtgctgcagtgggcgtacatgtgtatgtatctttataatggaatgatttatattcctttgggtatatacccagtaatgggattgctgggtcaaatggtatttctggtgctaggtctttgaggaatcaccacactgtcttccacaatgattgagttaatgtacattcccaccaacagtgtaaaagcgttcctatttctctgtagcctcaccagcatctgttgtttcttgactttttaataattgccattctgactggtgtgagatggtagctcattgtggttttgatttgcatttctctaatgatcagtgatactgagcttgagctttttttcatacgtttgttggccacataaatgtcttcttttgagaattgtctgttcatgtcctttgcttactttttaatggggttgtttgatttttttcttgtaaatttgtttaagttccttgtagattctggatgttaggcctttgtcagatggatagattgcaaaaattttctcccattctgttggttgtctgttcaccctgatgatagtttctttagctgtgcagaagctctttagtttaattagatcccatttgtcaatttttgcttttgtggcaattgcttttgacatttttgtcatgaaacctttgcctgtgccatgtcctgaatggtattgcctagattttcttctaggttttttatagtttggggttttacatttaagtctttaatccatcttgagttaatttttgtataaggtgtaaagaagggttccagtttcagttttctgcatatggctagccagttttcccagcaccatttattaaatagggaatcctttccccattgcttgtttttgtcagctttgtcaaagatcagatggctgtagatgtgcggtcttatttctgagttctctattctgttccattggtctatgtgtctgtttttgtaccagtaccatgctgttttggtcactgtaacctggtagtatagtttgaagtcaggtagcgtgatgcctccagctttgttctttttgcttacagttgtcttgacttgtacgggctcttttttgcttccatattgaattttaaaatagtttttttctaattctgggaagaatgtcaatggtagtttaatgggagtagcactgaatttataaattactttgggcagtatggccattttcatgatattgattcttcctatctgggagcatggagtgtttttccatttgtatgtgtcctctctgatttccttgagcagtggtttgtagttctccttgaagaggtccttcactccccttgttagctgtattcctaggtattgtattctctttgtagcagttgtaaatgggagttcattcatgatttggctctctgcttgtctgttgttggtgtacaggaatgcttgtgatttttgcacattgactttgtatcctgagactttgctgaagttgcttatcagtttaggtagcttttgggctgagacgatggggttttctagatagaagattatgtcatatgcaaacaaagacaatttgactttctctcttcctatttgaataccctttatttctttctcttgcctgattgccctggccagaacttccaatactatgttgaataggagtggtgagagagggagtcctatcttgtgccagttttcaaaggaaatgcttccagcttttgtccattcagtgtgatattggctgtgggtttgttataaatcacccttattattttgaggtatgttccatcaatacctagtttattgagagtttttagcatgaagggatgttgaattttatcaaaggccttttctgtgtctattgagataatcatgtggtttttgtcattggttctgtttatgtgatggattacgtttattgattcgtgtatgttgaaccagtgttgcataccggggatgaagctgacttgatcgtggtagatgagctttttgatgtgctgctggatttggtttgccagtattttattgaggattttcacatcaatgttcttcagggatattggcctgaagttttctttttttgttgttgtatctctgccagattttggtatcagaatgagctggcctcataaaatgagttagggaggagtccctctttttctgttgtttggaatagttgcagaagaaatggtatcagctcctctttttacctctgaattcagctgtaaatccatctggtcctgggctttccttggatggtaggcttattactgccccaaatcagaactccttatgggtctattcagggattcaacttcttcctggttcagtcttgggagggtgtatgtgtccaagaatttatccatttcttctagattttctagttgatttgcatagagatgtttatagtattctctgatggttatttgtatttctgtgggatcagtggtgatgtcccctttatcattttttttgtgtctgtttgattcttcttttcttctttattagtctagtagtggtctattttattaatcttttcaaaaaactggctcctggattcgttgatttttttgaagggtttttcgtgtctctatctcctgcagttctgctgtgaccttggttatttcttatattctgctagctttggggtttgtttgctcttggttctctagttcttttagttgtgatgttagggtgtcgatttgagatctttctagctttttgatatgggcatttagtgctatccatttccctcttaacactgctttagctgtgtcccagagattctggtatgttgtctctttgttctcatagtatcaaataacttcttgatttctgccttaatttcattatttaccgaggagtcattcaggagcaggttgttcaattttcatgtagttgtgtagttttgagttagtttcttagtcttgagttctaatttgattgtcctgtggtctgagagactgttataatttcagttcttttgcatttgctgaggagtgttctacttccaattatgtgatcaattttagagtatgtgccatgtggcaccaagaagaatgtatattctgttgtttttgggtagagagttctgtagatatctatcaggtccacttgatccagagctgagttcaagtcctaaatatacttgttaattttctgtctcaatgatctgtgtaacattgactgtggggtgttaatgtctcccactattattatgtgagagtataagtctctttgtaggtctctaagaacttgttttatagatctgggtgctcctgtattgggtgtatatatatttaggatagttagctcttgttgaattgaaccctttagcattatgtaaagcccttgtttgtcttttttgatctttgttaaagtctgttttgtcagaaactaggattgcaacccctgcttttttttgctttccatttgcttggtaaattttcctccatccctttattttgagcctatgtgtgtctttgcacatgagaggggcctcctgaatacagcacactgatgggtcttgattctttatccagcttgccattctgtgtcttttaattggggcatttagcccatttacatttaaggttaaaattgttatgtgtgatttgatcctgtcatcatgatgccagctggttattttgcagacttgttattgtagttgcttcatagtgtcattgctttgtgtacttcagtgtgtttttgtagtggctggtaatagtttttcctttccatatttagtgcttccttcaggagttcttgcaaggtggtcacaagttccctcagcatttgcttgtctgaaaaggattttatttctccttcacttatgaagcttagtttggccagataggaaattcttggttggaaattcttttctttaagaatgttgagctgggcgtggtggctcacgccggtaatcccagcactttgggaggccgaggcgggcagatcacgaggtcagaagatcgagaccatcctggctaacacggtgaaaccccatctctactaaaaatacaaaaaattagccaggcatggtggcaggcgcctatagtcctagctactcgggagtctgaggcaggagaatggcatgaacccaggaggcggaggttgcagtgagccgagactatgccactgcactccagcctgggtgacagagcaagactccatctcaaaaaaaaaaaaaaaaaaaaaaaaaaaaacagaatgttgaatattgactcccaattgcttctggcttatagggtttccactgagaggtgcactgttagtctgatggacttccctttgtaggtgacctgtcctttctggctgcccttaacattttttccttcatttcgaccttggagaatctgatgattatgtgtcttggggttgatcttctcatggagtattttactggagttctctggatttcctgaatttgaatgttggcctgtcttgctagcttgaagaagttctggcctgtcttgctaggttggggaagttctcctggatgatatcctgaagtatgttttccaacttgaaacggttccgttctccccgtctcttccaggtacctgaatcagccgtaggttcggtatttttatgtaatcccatagttctcagaggttttgttcattccttttcattcttttttctctcaccttgtctgcctgtcttatttcagcaagatagtcttcaagctctgagattctttcctctgcttagtctcttcagctattgatatttgtggttgcattgtgaatttcacattgtgtttttcagctccatcacattgtttatgttcctttttaaacgggttattctggttaacagctcctataatgttttatcatggttcttggcttctttgcattgggttagaacattactccttttgctcagcaaagtttgttactgcccagcttctaaagcctacttctgtcagtgcatccatctcagcctcagcctcagcccagttctgtgcccttgctggagaggtgttgtgatcatttggagaagaggcactctggctttttgagttgtcaccgtttttgtgttgattctttctcatcatcctcagtttatctaccttcgatttttgaggctgctgacctttggatggggtttttgtggggtctttttttgttgatgttgttgttgttgctttctgtttgtttgtttttaacagtcaggcccctcttctgtagggctgctgccatttgttgggggtcgaatccataccctactcgcctgggtccctctcgcatctggaggtattaccagtggaggctgcagaacagcaaagatggctgcttgctccgtcctctgggaggaagcactgacctgatgccggcaggaacgttcctgtataagatgtctggcaacccctggtgggtctcagtcaggaggcacgggatcagggacctgcttaaggaagcactctgactgccccttggcagagcagctgtgctgcactgaagggaatccccctcctctggactgcccagacccttcagagccagcaggcaggaaagactaagtctgctgaaccacgaagacgatagtcacccctgcccccaggggctccttcccagggagatcagttctgctcataaacccctacctggagttgctgacatttctgcagggaggcctcgcctagtgaggaggaatggatccgagtcccacctaaagaagcggtctggccacaatctgccactaccactgtgctgtgctgtggggaattcctcctggtccaaaccacctattctccccggcactggcaggggaaaagggcagactggacctgcagtgatggtggctatcccgggaacttggtcgtcttaggcaatctccagcctgctgctgctggctgcaacctcagtggccactgagcatctgggcagctctgtgcttgggatccaaggccctgttggcctgggctcacaaggggaatctcctgatccacgggttgcacagatctgtggaagaagcatggtttcctgggcagggtgccacaatcactcatcgccttccttgattgggggtgggaactccccttgccctgtgcggctcccaggtggggctgttgcactaccctgcttttcctcactctccgtgggttgtgccaactgcctagtcagtcccaatgagagaacctggttacctcagcctgaaagtgcaacattcactcgctgttttcattcttgataggagcagccaacagcagctacttctagttggtcaccttggcccctccaccgaccttgccagtcttttaattaagttgttcctttccccatccttccttccttcttcttatcctttttctcctgctccttctccagccttattgcactgactaaaaccttcagtacaaagttgaatagaagtggtaggattagtcatcctattgttattcctgctcttagggagatagcatccagtctcacctttcattatgatgttaggttttccctagatgccctttatcaggttgaggaagttccattgtaatcatagtttattgagtattgttaatcatgaaaaggtgttggattttgttaaattcttttactgcatctattgagatgatcaatgtttttcttttttagtctgctatagttgattatattcattaatttttgaatattaaaccaatcttgcattcctagaataaacctcacttggtcatggtgaattatcatttttctattttgttagattcaatttgctaaaattacgttaagaatgtttgcattgtctgagcatgttggctcacacctgtattcccagtactttgggaggctgaagcaggaggactgcttgaggccaggaattcgagaccagcctgggcagcatagcaagaccccatctcagcaaaacaataaaaattaactgagtgtggtggcatgcctgtgttcccagctactcaggaggctatggtgggaggatcgcttgagcccagaagtccaaggcctcagtgagctattatcacgccgctgcactccagcttgaatgacagagggagactctgtctcaaaaaaaaaaaaaattgattccatatgtatgaggatattggactatagttttcttttctcataatgtctttatttggttttggtgtcagagtaatgcttgctgaccttagagaatgagttgagaagtactgccacctctttaaattagtggaaaagtatgtgtggagatgttgttatttctcccctaaatgtgttgtagagtttatcaataaagccatctgggcctggagttttctttgcaggaagatttttttaaactaccaattcatttttttaaagatacagggtttatgcaggttatctatttcttcttgagtgagctcttgcaatttgggtctcaaggaatttgtctatttttattgaagttgtcaaatttattggcatgatattgctcataatattcttactatccttttaatatctatagaacctgtagagactgttatttttttcatgtaacaggtttattgagatataattcacatacaatacaatatactcatttagtgtatgatgcagtagttcttaatatattcatagttttataaccattaccacaatcaatttttgaacatttttatcaagccaaaaagaaattccatactcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaagaaattccatactcattagtagtcattccccatttccctccaattcccactccctcagcccttagcaaccactaatctattttctgtctctgtagatttccctattctggatgtttcatataaatggaatcacataatttatattgttttatgattggcttctctcatttagcataatggggttggggggggctttttaaatgtaattttaaaaagtatatattctttttcatagagacgagtctcactatattgcccaggctgagccactgtacccagccctagcataatgtttttaaggtacatccatgtcatagtatctatcaatatttcattcctggccaggcacagtggcagatgcctgtaatcccaacactttgggaggctgaggcaggaggatcacttgagcccaggagtttgagactatcctgagaaacaaagggaaaccccattctttacccctccctccccgacacacacacatacacacacacacacacacaaaattaatagggcatggaagtacatgcttgtggccccagctactcgggaggctgaggcgggggaggatcgcttgagcctgggaagttgaagctgcagtgagccgtgattgtgccaccacactccagcaggcagcagagcaagactgtcttaaaaaaaaaattcatattttctatggctgaataatatctatttcattttataggtacaccacattttttatccatttattagttgatgtacattaggattgtttctacttttgggccattatcaataatgctgatgtgaacatttgtgtataatttttttgtttttgttttgagacacagtctcactctgttgcccaggctggagtgcagtggggtgatctcagctcacttcgacctctgcctcctgggttcaagcgattctcctgcctcagccgcctgagtagctgggattacaggtgcgtaccaccatgcctggctgatttttctatttttagtagagacgaggtttgaccatgttggccaggctggtctcaactcctgacctcaggtgatccaccagcctcggcctcccaaagtgctgggattatatccgtgagccaccatgcccggcctcgtgtataagtttttatgtgagtatatgttttaatttctcttatgtgtatatctaggggtagaattgctgtgtcatatgctaagtatatgtttaacctttttatttatttatttatttatttactgaggtggagtctcgctctgtcgcccaggctggagtgcagtggtgcagtctcagctcactgcaacttccgcctcccaggttcaagcaattctcctgcctcagtgtcccaagtagctcaggttacaggcacatgcaaccactcccggctaacttttttgtatttttagtagagacagggtttcaccatattggccaggctggtctctaactcctaaccttgtgatctacccgcctcagcctcccaaagtgctaggattacaggcatgagccactgcgaccggcctatgtttaaccttttaaagaactaccagacttttccaaaacagcagcaacagtttacattcctgtcagcaggggatgcgtgctccaatttctccacatccccaccaacaattgttattaacttttttatactgttccattgatctatatctctgttttggtaccagtaccatgctgttttggttactgtagccttgtagtatagtttgaagtcaggtagcgtgatgcctccagctttgctcttttggcttaggattgacttggcaatgtgggctttttttggttccttatgaactttaaagtagttttttccaattctgtgaagaaagtcattggtagctttatagggatggcattgaatctataaattaccttgggcagtatggccattttcatgatattgattcttcctaccatgagcatggaatgttcttccatttgtttgtatcctcttttatttcattgagcagtgttttgtagttctccttgaagaggtccttcgcgtcccttgtaagttggattcctaggtattttattctctttgaagcaattgtgaatgggagttcactcatgatttgtctctctgtttgtctgttattggtgtataagaatgcttgtgatttttgtacattggcaccgaacagagccctcagaaatcacgccgcatatctacaaccgtctgatctttgacaaacctgagaaaaacaagcaatggggaaaggattccctatttaataaatggtgctgggaaaactggctagccatatgtagatgaaactggatcccttccttacaccttatacaaaaattaattcaagatggattaaagacttaaacgttagacctaaaaccataaaaaccctagaagaaaacctaggcgttaccattcaggacataggcatgggcaaggacttcatgtctaaaagcataccaaaagcaatggcaacaaaagccaaaattgacaaatgggatctaattaaactaaagagcttctgcacagcaaaagaaactaccatcagagtgaacaggcaacctacagaatgggagaaaatttttgcaacctactcatctgacagagggctaatatccagaatctacaatgaactcaaacaaatttacaagaaaaaaacaaacaaccccatcaaaaagttggcgaaggacatgaacagacacttctcaaaagaagacatttatgacgccaaaaaacacaagaaaaaatgctcaccatcactggccatcagagaaatgcaaatcaaaaccacaatgacataccatctcacaccagttagaatggcaatcattaaaaagtcaggaaacaacaggtgctggagaggatgtggagaaacaggaacacttttacactgttggtgggactgtaaactagttcaacccttgtggaagtcagtgtggcgattcttcagggatctagaactagaaataccatttgacccagccatcccattactgggtatatacccaaaggactataaatcatgttgctataaagacacatgcacacgtatgtttattgtggcactattcacaatagcaaagacttggaaccaacccaaatgtccaacaatgatagactggattcagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccacatgttctcactcataggtgggaattgaacaatgagaacacatggacacaggaaggggaacatcacactctggggactgttgtggggtggggggaggggggagggatagttttaggagatatacctaatgctaaatgatgagttaatgggtgcagcacaccagcatgtcacatgtatacatatgtaactaacctgcacagtgtgcacatgtaccctaaaacttaaagtataataataataaaataaaataaaaacttttttattatagccatcctcatgggtgtgacagtgatgtctctcttgttcttaatattggtaacttgtgacttccctcttttgtctttatcagtctagtagaagtttattggttttgttgaacttttcaaagaaccaacttttgggttaattagttttctctcattttttgctatttcattgatttctgctctggtctttgttatttcctttcttctgcttattttgagtctctttttctaatttcttaagatttaaactaagatcattgattggagatctttgctgatataggggttttaatgctatacatttcttgctatgtactgctatactagatctcacaaatttaatgaattgtatttctcattcaattcaaaatgctttcgagtttccctttgatttcttctttgattcatgggtgatttagaagtgtgttataaaatatttgaggatcttccaaatattattctctaattaatttctaatttaatttcatgtggtgtaagaacatattttgtatgatatgaatcttttaaattattgacttgttttctgtcccagacagaatatggtgataaatgtcttacctgtatgtgagtagaatacgtattgtgctcttgttggcaggagtgttccataaatgtcaattacgtcaaattcattgatagtattattagagtttctgactaattttatcagttattgagagaggggatccagctattgtggatttgtccatttcttttttatttctgtcagttttgctttacgtattttgaagctctgtcattaggtatataaacatttagaatcattgtgtaccccttgttgaaatgatccttttatcattctgaaatgacccttttaatacctagcagtatttttgctatgaaatctactttgtccgacattaatatagacattctagctttcttttgattagtgttagcataatatatttttctgtccttttacttttaacctatttgtatctttatatttattaaagtggttttttcataaggaatatatagttgggtcttgcatttttatccaatctaacaacctctgccatttcattgacatgtttagaccaaggatcagcaatctatagcccacagggcaaacctaaccactgcctgcctttggaaataaagttttattggaacgcagccaagtccattcatttgtgtattgtctgtggctgctgtcacactccagtggcagagtttgctcacctataatgcagaccatttacatttcatgtgattattgatgtggttgtttttttttttaacgtggttggattttaaaccactgtgttgctatttcttttcattggtcccatctgttcttttctccctttttcctttttttaaacttccatcttggggattaattgggaatttttcattattccatttgatatcgtttgttgacttattagctataactcctttttctgttattttagtatttgctgttagagcattcagaaaataaccacaaggaattaccctgggatttcttgattctcttaatctgacttcatctaccaaaatgttacctttttggctcctgataaattaaggcataatgccgtagctttattcccattgactctttacagaaaagaaagatggaggacatagggacttttgtttgcctatatatgagtatccgaaatagatttcctatatatgatttggattaagagtagaattgcatttttaggaacattgacctgtaagatatgttatagtgattaattcattagtttcagtcactttttgaaatagtaagtgattgttaagatgctccaaggtaaaaatctgcatctttgcaggctaccatcaatattgtttttgatcgagttgggaaaacggatcctgtcacaagaggcattgagatcactgtgaattatctgggaatccaatttgatgtaagtgttatatcaagatcctggtttgtcatgtttctgttttatctgctataacttatcattgttaagattctaatttgtatactttaggtacttgcttctgcttttgttcttcccactctgtatattttgacgtattcacatggaaaatttttatattttgatgtattcacatggaaaatttgtaaaaggccaagattctctctcttaacataaagccagaagtaatgactgatacttaatattgtcacggatgctgattatttctacagctgctcctctgcttctctataggcagctaccagtttaccattttctccccaccaaagtattcaaatacttctctctgtgattcttattgagctcttcaaacacacaactcagctttgatgctccagtggaaaattagctactaattagtgttctgtgttagagctgaaatgatttctgctgtaagaaatgatctttatctattaatgtggaccttgggctaaagatggtaactgtcacctatgcacaaaatttttttttaaattgtctttttactgtttcataataccactgtcataaatacacccttgtcctaattgaagttcagtgtctttattcataaaccagagccaatgactctggctgaatagcactttaatagtaagaccaatgtcatattcttagtcccagtgtaggccatttagctgtgctgtcaacctagacgcagactgcgtgctacccccagccatccatcccagccagacgtgcccctaatctcaaaaggacttggatgaaatgaaaatgaacaagagcaaattgagccccaatccttgagaaacagctcaatgtacatgtttcttgatgctagatcaatagtgtatcctctttgagtgtgaaggaacatgatatcttttcttcaagtggtatataaattatattaagtatgctttacaggccacgcagtactgtggcccacatctgtagtcccagcactttgagaggccgagacagatcacttgagtccaggagttcaagaccagcctgggcaacatggtgaaaacctgtctctagaaaaaatataaaaattagctggacatggtggcatgcacctgtagtcccagctatgcaggaggctaaagcaggaggatcacttgagccggggagaaagaagttgcagtgagctgagatagtgccactgcactccactctgggcgacagagtgagacccctgtctcaaaaaacaacaaaaagtatgctttgctgttgttgcatttgtgtttccttaagtgttttactgggctgaatttttagcaatgcttttgcttttctgtactttctgaggatacttacatggccatgtatatatttcatctgtaattcatctgtttatgctatattttgtaattctgaataacaaatcatttagatgttagtaatagcagctccctttcagatacttttcagaactgaatcaaacacagggtcccaaaactccttctcactatgaagcaatacaggaggagaaaaaggtatcatgtggttccagtgaagttcaactatttcctagaatttagctgagaatgtctatatattcttttactataaaaagaaagattccttgaagttttggtgattagggaactattattcatagatagaaaataatcaaggtattatttagtttccttttaattcctgcttttcatttatcacagtaaaactgtatcattagttctgtttttttctgatttattagcgttatttttatcactgcttggtacttgctgccgggcatggtgactcatgcctgtagtaccaacactttgggaggctgatgtgggagtattgcttgagcccaggagtttgagacgagcctgaactacatagcaagaccctggctctacaaaaaaaatatttttttaattttaaggtttaattaagtctgctaattaaggtatttactgcagtctttctgtagttgttttatttgccacttacttgctttcctctctcccttaagaaaaaaaatcaggtagggtctaataaagctccctctcacagtcatgtaaatgattgggatatagcttagcccttacgtctctctgaacagagatttagcagatattttttcttgttatggtggcaggtgaagttttggtcccaacacatttccttcattcttgttggaataatcatcgtcacatccatcagaggattgctgatcactcttaccaaggtatgttttatcacagtgttaaaaagtactgcttatcatttgtttaattaaatgtggtaccagccgggtgtggtggctcacgcctgtaatcccaacactttggaaggctgaggtgggtggatcacgaggtcaggagatcgagtccatcctagccaacatggtgaaaccccatctctactaaaaatacaacaaattagctgggtgtggtggcacatgcctgtagtcccaactacttgggaggctgagttaggagaatcacttgaacccaggcagcggagattgcagtgagccaaggtcacacactgcactccagcctggtgaaagagcaacactccatctcaaaaaaaaaaaaataggtggtaccatgagataattttacctcattaagaattctgcctcctgagactttaaacaacagtgtcaaggatttaaaagacatacaacagaattttttaaaagttaaactactacataaattgatgatgatatatttacatcatataccaattatagataagtacattcactaaaggtgatagagtaagatatgggtctgttttgttcactgatatgttatcagtatctagaacagaacctagcacatggtaggcagatattcagcagatatttgagactggaagaatagttgtgagagtcacttacagagaagatatggaagtaagggagcagaatatagcaagtccttaatgtcatcaataagttcttggaaacagcagctttaagcaaaactatataccaagtcctcaaaaaaatgtttcattcaacatttcattataatgctgtgagaaaaatgtagttttgttatacatcatttcacttaaaatctcagtttccaagatcctataaatggcattaagtaaggacctactgaattcaactattttctttttttttttttttaaattatactttaagttctagggtacatgtgcacaacgtgcaggtttgttacatttggatacatgtgccatgttggtgtgctgcacctattaacttgtcatttacattaggtatatctcctaatgctgtccctccccccttcccccaccccacgacaagcctcggtgtgtgatgttccccttcctgtgtccaagtgttctcattgttcaattcccacctatgagtgggaatatgcagtgtttggctttttgtccttgcgatagtttgctgagaatgatggtttccagcttcatccatgtccctacaaaggacatgaactcatctttttttatggctggatagtattccatggtgtatatgtgccacattttcttaatccagtctatcattgatggacatttgggttggttccaagtctttgctattgtgaatagagtatgtgaatagtgaatagtatgaatattgcacacgcaataaacatacgtgtgcatgtgtctttatagcagcatgatttataatcctttgggtatatacccagtaatgggatgactgggtcaaatgttatttctagttgtagatccttgaggaatcgccacactgccttccacaatggttgaactagtttacagtcccaccaacagtgtaaaagtgttgctatttctccacatcctctccagcacctgttgtttcctgactttttaatgatcaccattctaactggtgtgtgatggtatctcattgtggttttgatttgcatttctctgatggccagtgatgatcagcatttttccatgtgtctgttggctgcacatgagaagtgtctgttcatatcctttgcccactttttgatggggttgtttttttcttgtaaatttgtttgagttctttgtaaattctggatattagccctttgtcagataagtagattgcaaaaattttctcccattctgtaggttgcctgttcactctgatggtagtttcttttgctgtgcagaagctctttagtttcattagatcccatttgtcaattttggcttttgttgccattgcttttggtgttttagacatgaagtccttgcccatgcctatgtcctgaatgttattgcctaggttttcttctagggtttttatggttttacatctaacatttaagtctttaatccatcttgaattaatttttgtataaggtgtaaggaagggatccagtttcagctttctacatatggctagccagttttcccagcaccatttgttaaatagggaatcccttccccatttcttgtttttgtcaggtttgtcaaagagcagatggttgtagatgtgtggtattatttctgagggctctgttctgttccattggtctgtatctctgttttggtaccagtaccatgctgttttggttactgtagccttgtagtatagcttgaagtcaggtagcgtgatgcctccagctttgttcttttggcttaggattgacttggcaatgcgggctctttttggttccatatgaactttagagtagttttttccaattctgtgaagaaagtcattggtagcttgatggggatggcattgaatctataaattaccttgggcagtatggccattttcatgatattgattcttcctatccatgaacatggaatgttcttccatgtgtttgtttcctcttttattgtgttgagcagtggtttgtagttctccttgaagaggtccttcacatcccttgtaaattggattcctaggtattttattctctttgaagcaattgtgaatgggcgttcactcatgatttggctctctgtttgtctgttattggtgtataagaatgcttgtgatttttgcacattgattttgtatcctgagactttgctgaagttgcttatcagcttaaggagattttgggctgagacgatggggttttctatatatacagtcatgtcttctgcaaacagggacaatttgacttcctcttttcctgattgaatatcctttatttctttctcctgtctgattgccctggccagaacttccaacactatgttgaataagagtggtgagagagggcatccctgtcttgtgccagttttcaaagggaatgcttccagtttttgcccattcagtatgatattggctgtgggtttgtcataaatagctcttacgatttcgagatacgtcccatcaatacctaatttattgagtttttagcatgaagggctgttgaattttgtcaaaggccttttctgcatctattgagataaccatgtggtttttgtctttggttctgtttatatgctggattatgtttattgatttgcatatgttgaaccagccttgcatcccagggatgaagcccacttgatcatggcagataagctttttgatgtgccgctggattcagtttgccagtattttattgaggatttttgcatcgatgttcatcagggtctaaaattctctttttttgttgtgtctctgccaggttttggtatcaggatgataccctaactcattttatgaggccagcatcatcctgataccaaagcctgaattcaactattttctaatcaacgtaggaagacttcacggaggtggaaagtgagtcctctctggtaggaaaggtagggatttaaaaatccaggagcttttgaatgaaagagaagtggctgggacaggaagggatctgcaggcatctagcacagttttagaaagagcgtgggagcctactaacaattacaaccgcttggagtgggctggagtgatctgacttaatgttttatagtgatgttaagtcatatgtatcacatagtttctgaagtttgatagcaataggaatcctttcatatgttatgtaattaaattacccccagggggaaagtataactttttcagcagtctattttaagtctcttctttatagtcttaatcatatgaattgttctatacaggattgtggcatggaagagacacttttaatcaaatgttaaccatatttcttactgttcgtgacacaggaatctaacagtactgcataaatttatctccctctttcttgacagttcttttatgccatctctagcagtaagtcctccaatgtcattgtcctgctattagcacagataatggtaagtttaattagttacctttatgttgacagctgtaaaatatcagaaatgtgcttgatacttttaagaattttaataatttcctttgtcctgttcctcactacattcagagtcacttctggattaattcatttgacttacagggcatgtactttgtctcctctgtgctgctgatccgaatgagtatgcctttagaataccgcaccataatcactgaagtccttggagaactgcagttcaacttctatcaccgttggtttgatgtgatcttcctggtcagcgctctctctagcatactcttcctctatttggctcacaaacaggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccctcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagagatgtctatggtagctgagccaaacacgtaggatttccgttttaaggttcacatggaaaaggttatagctttgccttgagattgactcattaaaatcagagactgtaacacttttgccttacgttcattttatcaagcatagcttggtatttattatgcttgtgtgatctaacatgagttagcatcccacacctcctcttctgatcctgccccattaaaataaccaagaggttatctgttcttttccgggaaaggggtggtatgcacctgaaatagattttaccaaaagagagatttcagttatgtcattttttcttgatttcctgtgaacttagtattataccctactttcaattcggtagtgatgtttcctttttttttctatctgcccctcacgctgtggggtgaaaccgtgaataacttaactgggggaataagtcacttgtgaaagggaaatgttgaaaaatttttagaacactcagacatgcaatttaagaaaattctgaattttattactaaggtcttattctgtactttattgtgttttgggtttctagaggcaaatgaaggttaaagcataaaaagtgaatccaaaacaaaagcactatcaagcatactcaaaaggcatttgttaatggtatttattctagcaaccacaacattgttacaaaagcacaattttaataggcttatctgctaagatgcttttataagcagctgtcacctatacagagttatgaatcatctttggtgctcaaggaacctgtagaagtaagagacatcatcatacagagaaatgtagttaagttgaagcttggaaaagatcacatgaaaaaaatctagctcttgccttatctcttcctaagttaagcataaattagccgtctgcaatagccgcctgtaagacaaatgataacagaagacaatcacacatggtgaatggtttccagtggagtttttcttctaaagagacagtaaacaggtcgcaactcattctttgagaaaggattcctattaaatacccagaaacagctatcaaataaacagccaaagctattacttgttttcatcacatctctgtatcttcagaattggaagaagaatgtgaggctgtactgtgggcctgtgtataagaaaacaaagaatttacaaatggtagagtaatgaaagagggatgatctattctagagttgcatgacttaagtcggggagtagagtcactcactagaatttctttctttcacagcatgcagttgacagcaattgtgtagagctgataaatcaagtaaaaagtttatcagtattgtaatgggaacccccagaagagcctgaatcagatgatctaggtatgactagaagtcaggtgacctgaattctacacttgattgttttcaacttgctgtttgacacattaacaaattccttaatgtctgtgtatatttcttttgtataagactaggatattgacttcctaaagagaaattacagaatttttaaatgacaactaatacaactaatagtatttattaagcattcctgaatacaaatcagtgggcattgtgtgtgttcattaaactgagtttattaaaatgaatattccacccattagcagaattaatataatggaaagaagaacaacattgaattaaacttttttagagtctcggctttgctataaatttcctttatgaacttggataagtcagtttacttttggacctcaagttcatccaggaaaaattgggcaaaaatataaaactgagacttaccaagaaatttaatccaaatatatagagaataatatagagaatgcttaatctttcctagtaataaaactggaatacctgtcaattgttttaaacaatattgtctttaaccgtcaccacttacatgctcactatgagccagccactattcaaagcactttaatatagttaatcttagttaacatgatcctgataacaatcctacaaattattcctgttttatgggtgggaaaactgaggaacagaacaaataaatccatttccccacagctgacaaatgacagaaccagaattcatatctagatcatccgattcaggctcttttgggggttcccattacaatactgataaactttttacttcttgatttattagctctagacagttgctgtcagctgcatgctatgaaagtaagaaatttgttgttcttatactgcctcctgtcctctacaataacttgatttgttagttatctttacattgtcattttctagttttaaaaaaaatctgtggcaaacatagacattaaatatactcatagggactgtacccatactctagtaaattagatcatgaaaagaaataggcccccactcacccgttcttttgccatgtgcgagtcatgctttgactccaccactattccttctttagaatctggaggggtgtcaagtggatcagccagggaggaaacaatagggattttcttagcttggaaataatcataggccttctttccacagactagaagtgtgacattcttcccactgctctggattctatccaccaccttctcatagggttcatctagcacattcaccccattcacttcaatgatgacatcctcatcctctagcccagccaagtcagcaggaccgcccttctgtacctgtgaacagaagttctgagttatcaatttcaaacagagaaggggacatcagactagctctccttaagaggatagatgaggagctcaagaatttatttttaatcatgttattatttctccttgaggtatagaagttgagaaaggtgttctaatgcttttatatttatgaaggctataacttccatattcacatgattagtggtattataaatagtggttcagcgtcatatgtcttctgggatgaagggggataaataggtcccccttcttcactcccaacttgaaagctatagggattcttatcagtccctacagggtaaggggcattatgccaaatgcacagaagcaaacaaatatgactgccaatcagggttgatagtgactgtcaactagagttcagtcaactcacactgtttggaacagatgtttgggaaacaaacaaacgtgagcttatgatgtactggtagctaacctaaagggtgtgggaccatgacaacatttatctgaacccaagtgagacccctcagtgtgtgccttcaatggaacctctctactaagccatcaatgggtgggaaaagctgagactatcctaattgtggctgtgtttgttgggctgctggaaccagattaccatacctctttgatgaatgagcctggcagaccccgaatcgcatttaagtgaaagccatagccattttcacctttagccagcctgcagagtttaggcttatgatcttcttcctctgtagtatctggtggacttgagacttccagagaagtgggagtaggagctggagcctccttgacagagccattgggcagttcttgactttgatagtagagaaatggagaaaaatgagccttttgaaaaataaagggaaaaaacattaacttagttgtaaccatgagtaagttatactttgttaaatgtgctgatttttaaggtatcatacatattccactcttcttctggatgtgtctgattgtaggctgtaaaattcctctactaccccaaccaggaaaggtataaaagaagactgtgcttcgttatggagtaatatgtgtatacatgtacacaaatgcacacatgaacataaaagcagtataggatgcggtacaaggatcccaaaagaagtctaaaaaattgctagtttcttttgagttcatgatagtgagcaagtcactgaacaagctatacataatctccctgttgggaaatgacatatctgactgactagccggtacctcatgcagagtacattcttctggcttttcctttcggtaagatggtcttcagagctccttaaacacattagaaaaagtaaaacacaagacacttgtgatagttaattttagatgccaacttgactggattaaggaatacctagaagcccggtaaagcattattttggtgtgtgtctgtgaaggtggttccagaggggattagcatgcgagtctgagtgaactacagaaaaggcaaaggtgtcagtctgtctgctagagctgggatacactcttcctctcctgtgcttggacatcagaattcctggttctccggcctttggactctaagatctacagccgcagccccccagattctcaggccaaatgcacagaagcaaacaagtaggactgccaatcaggggtgatgccagtaatgtggctcagtcagatttggacggagccacactactggcatcccagggtctcaagcttgaagacagcctgtcgtggggcttctcagcctccataatcacacaagccaattcccctaattaatctcctctcatacctgtatctatatcctactagatctgtctctctggagaatgttaatataacactatttttatcactatccaaagattcaaagctactagaagagaccaacccatatacacagtaataattggtgagagggtgacagctgttatatggtcacatattgtaacaaaagttaattccaaccctttgctgcttgccaataccctccccttccagacctgggatctgcgcttatttattttgctatgtattgttgtaagcattagctgtcacttctattatgccaaactctccaacatctttaaatactcctaattcatatcaactcccagcccatccatgtgaagaaatgatgatcttgaataccgaagaggcatagaacaggaaacaggattgatttttttgtaatagaattacaagcctaactggctgttttagttgagacaattagaagggtggacctgggtatggtgtgatcctggatcagcagctaaatggctgcccacacgtgtccggaacatttgttaggtgatgagtaggaaatcaagcaatggaaggtgagcacagtgtgggctctacttcaaatcgcactgtttagcagcctgactaaaattagatttttagtcctctggttatcatgtgtcttactaaccacaagaccacatctccttcctttctaagtgagaataccaccagcacagaacctcctagttacccagttcaactaacttcagacctttcagtcatatacttgcaacagttccacaatggagcctttctctttaaaatatggaaaattatcaggtgactcattacatgcaaaaatacgtctgataacactacccaaacaagcaaaccaactgtatctgacagtcgcagctcatctcgaggcaaagtgcaataacatttaaaacacttgagattttggccgggcttggtggctcatgcctgaaatcccagcactttgggagtacaaggtgggcggatcacttgaggtcaggagttcgagaccagcctggccaaaatggtgaaacctcattctctactaaaaatataaaaattagccaggtgtggtagcacacacctgtagtcccagctactcgagagactgaggcaggagactcacttgaacctgggaggcagaggttccagtgagctgagaacataccattgcactccagcttggacaacagcgggagactctgtctcaaaaaaaaaaaaaaaaaaaaatgagattttattcatgcttcattcagataattgggtgtctagtatgtgccagggactgctagagggttgtgttttactcactgatgtatctcaaagatctaccctccaccccaacctacaggtcttactttggagagcggggaaggaggtgatgagggcaggcttctttttcgatcaaagttctctattaaccaaaacagaaaaattacaattaaatcattctatgataagatcaggaggggtcagaatcccctttacaacaaacagctgcagcagccgcctctgatttctgcttgactttccaccaactgcaaaatgactcatcatttctggcagcttcagttggttcttaagccaaaagctatctccctatggcttctctggtcctgttgtgccccataggacaccttaaaaaaaaatgtgtggcccgggcgtgttggcttatacctgtaatcccagcactttgggaggccgaggcgggcggatcacaaggtcaggagatcgagaccatcctggccaacatggtaaaactactaaaatacaaaaaatgagctgggcatggtggtgcgcacctgtaattccagctactcaggaggctgaggcaggggaatcgcttgaacccgggaggtggagattgcagtgagctgagatggcaccactgcactccagcctggtgacagagcaagacaacgtctcaaaaaaaaaaaaaaaagtgtgctccttcttacatgtaatagcctttcaaattcttgaagatgccctcttctccaaagccttactcaagctaaatactcacatggtggcttccaaaacctcttccctggttacccttgtcattgccttcttaaagtgaagttcttgaaaccggacacaatattgattgaacaaatagaacatttagatgtgtgaggcattattctacatgctctgaatattccaattcaaccctcatagccacccttcactgtagctactacccctctcttacaactaaggaaactgaagcacagagagaggtggtaactatattaccaggaattccaagtatggtctgaccaagtaagtacagtaagatggtcatctctagaagccaagtgtcagttaatttttaaattaccatatttggatgggacaaccacttggactatcaagtttctggtctttttctgtagtcctcaaatcaggtctcaccatgtggtattcatacaatttacttttaggttagtatagtacatctgaaatttattcttatttctttagttttcattctttctatcctaactaaatattttgagtattaattacaccatccagcaaatgaattatctagtgccactttaagtatgttaatatattttccatatctcctttcaactttaagcacataaacggttaggaacaagtagcatgccattagagacttctattcaagttgatattcaggttgatatcaagtattttctaggtatgattgttcaagtagctaaaaaaaaagccattaatctaattaattgtttaatcctgcttacaagattatcttgaaaaaatgtgctggggagtatggtataatgaattacaggtccaagaatttgggttcagataccaccttcagtctttactaagctgcgtgactttagcaaagtgcttagtctctctaagcttcggtttcctaatctatgaggagggcctaagatatcaccacccatcatattcccccctctgtaccgcttattttagattctactatcattgtatatcacagaggacatttatcttgttcatctttacaatcaacacttagcaagacagatggtacttagaaggccccccaggtatctgttaaactagacaacctcagttcttgtgttaaaagtaaaaaaaaaaaaaaaaaaaacaacaacaaaaaaaccttaaaacatgcagtagtgggtgttatgataaagagctgttaagagaaaataaagttagtttgattcaggttggtcttggtctatctgtgtttcttttttatttgctaagggcttacaagttgtttaataatcctttctaggcttttatgtgcagttgatagcacttaactgacctaaagcttaaaatctaattgtttcctattttgggaacaattttatttccaggcttatattctccatagattttctcagatcaccaagagtaagcctgcagttatattcacaaattctttcaaaatcttaagaccaaggacttaaaactcatttatcaatcatttggcattctcttatcactaccaatttgagttgagcttcagtttagccttaatgatgattgttatgcctcttccagtttgaggaacaaagtcctaactcagtgcaaaagttgaggtcatgagtgaatgggcccagccttaatgcatgaatatatggccttgtattacttaccagtctgtacatgttgtccgtctctttgtctaccaccaacagtgaagtctgatctccaccctttctaatcatttctaccacactgtcatgatccagggtttccacagactcgccgttgacagcaactaccagatcattgttcttcaagccagcctcctctgctggacttccagaatctatgtccttgatgatttgacctaccctcccccaaccccaaaaaataaaattatcagtaagtcccctaaaaaaataaaacagattttctgctggagcccaaagccctgatgaaatagataaaaaaggcatgctgagtacaactaccaccccttccaccagcatcccaggaagcttataagcacactatctaggctcgtttcctgctcagaactcaccccagaaactaacccagcaattaacaatgaaggggtcttaacgaaaataatcctgttactaaaagcatctgacatttgattttggcaaaatagcatattaaaaggctgcaagttcccagaaagtcagtgggcatacttgtagccacgcgtcttatgtaaaagctgtcataaaagatggggaagaataaagaacaaaacccaaaactttggaccttaagaaacccatgctggcattttagtagcaattgggtgtgttcggttttgaatatatttgtatatacatgcctccaggtgcctttggccttctggtatcttcaccagatgctgcttttttttttttttttttaacaagttcctgtttcacttttccagctagctgctgggtatctccaacaaaatatctcatagatctctcaactgtaatgtattcaaaccaaaaatcagctctgcccattctccatcccaaagcccctcctcttggttacctgttagtggagcaacatcatcccagtcaccaacacttggcaactgatttttccccagcatccagtccccatatctagacgattgctaagtcctctgatgctaccataataccttacacatcccacttcttctaccctgaatgcagtttgtattagttcctgcctagaattctacctaaactattacagcaccttacctactgctttcccttccccagtccttctgtctgatacagatctgccttcagatccatcttgatgcacattcctaaccaagtcacttcctggtgcaacagaatgagcatgggctttggaactaaacaactatttgaccttacataattactgtatcttctccaagccctcaatttcagcagttcttcttgcgtaattgttaggagtaattgagatgtgcaaagcccccaagacattataggctggtttttgttcttctcccttatactgctcaaaaaacaactccccattgtctgataagccaagttcaaactcatcagtcttgcatagaagtacccttgtcacttctctccaacctacctttccaacgaattcttgtactacacatcatgtgccaattaaactgtgccagtgtctcctgactgtgttcacatgactcccaccttcctggaatgatcttccttatcccagctctgtctactttcccaaatctattcatgttacaaagcctgaactcaagtgccacccctactatgagggcttctggtacctttttagtgagaaaagcttactctaacgttgaattatcacagtgcttgatctgcccctgtatgaaggtacttaacctctatctcccttcattatggacatatgtctcttatctactaaatggtagactccttgactaaagaattcctgtctgcttcatatgatattctttctccaaggcactgaggatgtttttacaaaacacaaaccaaattaatatttgataaattaatgtaaacagagagtgaaaagaaaataacaacttatgggcgaatagcagtttatacggcctgaactcatgttcttttatgtatttaccttccctgaaagaacctagtgttcttcctattgagttgcaaggaaggaggactcctggttctgagtcccaaatcctcacccacacctcggcctcaggtccagcggtgtgctatactggctcacaccggctcacaaaagccaattctgtgcaacacttcattgtgttcagtgacatcgtgttagtaagttgaaattggacatgggaggagtatttacatcacaaaatactaccaatttggtaccaaaaacaaacgctaccaatttggatttccccctacccccgccccagagagctaacttaccaggataccgttgcccagatcccaaattctgccttatcataatgctgtggaaacttttgatgcccaacatcagaccctcatgtgacatagacgctgacccagctgtgccttctatgctatgccgctcatgcatctggctgggagttgggaacctaatggaactctggagtcagaatgggatgaggaatttgctggttactgccaagtttcctgctcttgtaccttacctttctgttctgagcctgccctcagatagaaaccatagccattgcttcctttcttcatctccacaattcggggctggtggggtaacagtttcaaactggctgtttctcttttgaattgtatcttctgctcaacatgacgcttgtcagtttctttgtccaccagcaggaacatgacacggcttcctgacttcttcacctgtaacaacacacacagatgaggaatgacatcaacccccaagaacaatgctggggaataagaaagtttctgtataaaggcacacagtctctaggttcaacaaaagataggggatgaaaggcctgagtttaagctgttacactatgccctaccagctaactgatatgtatttatcgccttttttttttttttgagatggagtgtcactctttcgcccaggctggagtgcagtggcactatctcagctcactgcaagctctgcctcccgggttcacgccattctcctgcctcagcctcccgagtacctgggactacaggcgcccgccaccgcacctggctaatttttttttttttttgtatttttagtagagacggtgtttcaccgtgttagccaggatggtctcgatctcctgacctcgtgatccacccgcctcggcctcccaaagtgctgggattacaggcgtgagccaccgcgcccggcccctatctccacttctatagttgttttcccttatttaagtatgacctacccacataggtgctaactgagcccaagtaggagctggaattcagaaaacccataaaggtacctagataaaagctagaaagggagtttggaaaagaaaagaaagtaagggtccacgtcaaaaaatcattctacaaagagaaggttggtcaatttttaaggttccatatgacctcaaaggaaaatctcggttatctcccacttcctattaaagcatttcagtattaacggctcaacagtgaacttattgtaaattcagagggcgcagtggcacacgcccataatcccagcactttgggaggccaaggcgggcagatcacttgagctcaggagttcaagaccagcctggccaacatagtgagaccctatctctacaaaacacacacacacacacacacacacacacacacacacacataaaaattagccaggtgcggtggtgcacacctgtagtcccagctactcaggaagctgaggtagaagaatcatctgagcccaggaggccgagactgcaatgagccgagattgtgccactacactccagcctgggtaacagagtgagaccctgtctcaatcaaacagttcagagggggctcccaatcagatacaaacaagatccaaaaggtaaagttaataattttgtagacctcatgtgaaactagggaaggctttattccaaaaccctatattaacactgcttataccactagtgtgagtctgttcacccttaatatgaaggggcaactcaactggatattttttccatcataaactcatgctgtcccctaccacccctgtcttcctgtcacctccaatgagaatagagtggaagatagggtaagaaaagtaccctttggggcataccttttcaaccacttcctcatggctggcatcctctacattctctccattcacttcaatcaagtgatcatcagccagaactccagctctcatagccacaccttgaggtgtaatatcagtcatgtataccccctttttacctggaagagagtaggggtaaactccatgtggagacacaagtgactccctcttggatggtaatctgtgatgttgacttctgattagccccagtcctgtgattgcctcccgattcctacttcatttactgtccctagtctaagaacatgtcaaccttaatgttatcacacaaattataggctatgatgcactatagcattcttggctattgcagagggctgccttcgattgtcttgctggagcacatataccctttccctatggtatatcagccttgggtctggggagtaacacagagatctacatgttttgtggctgtccaagaccatgcttctgttcgtaagttcccctgataaattccaatgtaccaacaaactggatttgcctgccttgtcctttggtttctcagctcctttggcctttgagggactgctttgcttacaccaccctttcacagaacactccattgcaaagaaaaactcgaaatccaatggtaaagacttttctcccaataatgtgaaacaaacttccgattttagagctaactcggcctttggcttctgatctaaaatcacagttatagctcctgacactgaacttgacacagcctttactcagtgggtatttgttgatttgaatagaatttctgaggtcagctaaatgcaaagatggaatcttgggtggccttggccccttgcaccagaaagcgctaaaacatgcccacactgcattattgtgtcatacgccctttctttgcatttgtagaatcagaaagcatctttaccattctctcctcttcagtttgtactattatattagccatcgtatgctgcggagtcatctcaccaatgtaggctaacaaggacaggcacaggagggagggaagaacccgaatgcatttaggtggtgagatttaggtgctacttacagaaatgctgtcaattcttcaaagatattaatagagcagttcccccttaaccatgggggatacattccaagacccccagtggaggcctgaaactttaagatagtataccgaaccctatatgttttttcctgtgcttacatacctacgatagagtttaacttataaattaggcacagtaagagattaacaataactgagctaatcttagcaacctcagcatacagtattttttctttccttattaaatcgagaacttttcacttaatagaagcactttacagccttttttttttttttaacagatggagtcttgctctgtcacctaggctggaacgcagggccgcaatcttggctcacagcaacctctgcctccccggttcaagcgattcttctgcctcagcctctcgagtagctgggactacaggcgcctgccaccgcgcctggctaatttttgtatttttagtagagatggggtttcgccatgttggccaggcttgtctcgaactcctgacctcaggtaatccactcgcctcgcactctcaaagcgctaggattacagatatgagccactgtgcccagccactttacagcttctctttgtcatatctgaactgccagcatcactatcgttgcatttttggcttttttttttttttttgagacggagtcttgctttatcgcccagcctggagtgcagtggcgcaatctgagctcactgcaacctccgcctcccgggttcacaccattctcctgcctcagcctcctgagtagctggaactacaggcgcccaccaccacacccggctaattttttgtatttttagtagagacagggtttcaccgtgttagccaggatggtctcgatctcctgaccttaagatccgcctgcctcggcctcccaaagtgctgggattacaggcgtgagccactgcgcccggcctgagctattattttttattgatacataacatttgtacatatttatagggtgtgtgtcatattttgataccaagagcatatgatgaacaaatcagggtgtaatatttaggacatccatccttgaacatttatcatttctttgtgttgagaatatttcaaatcttcttacagctattttgaaatgtacaatacattgttgttaactacagtcaccccactgtgctatcaaacattagaacttattccttctctctgtgggtttgtacccattaacctagctctcttcatccccaccctaccccacacacatacccttcccagctgctggtatctctcattctactctctacctccatgagattcaccttttttagctcccacatatgagaatatgtgatatttttctttctgtgctgggccattattaagcaaaataaggattatttgaacacagtactttaataccgtgacagttgacctggtaactgagtagtaagtagtaagactaacaggcaggtaagcacatgccacgtggagatgctagacaaacagaggattcacgtccaagacggggcaggacagcacaagatttcattacactactcataatggttcacaatgcaaaaattatgtatggaattttccatttaatattttcagaccacagttgcctgcaggtaaggtaactgaaactatggaaagccaaacaggataaggggggactcttgtatgtcaacctaggcaagggatcgcttgctaatgactacataaatcacttgtaaggaatgacagtaacttaaactctgcttccttaaacactcagcatttctcctgctaccttgttatatatttgtcatgaagagaccattttcctcataaagctaacctaaaccattcaccatgtgcattagcacacgagccagatgagtagaatctgaattatgattttcttttttttaccactttactgataataggcttctaagacgtgccaagcttcctttgactatacacaccactgtgtttaataactgacagacctgagaaataccccttatcgtgagtttacatctcttggtacaggttaaataagccttagaaactattttaaatttaccactggtctgctgctgtatcacttgccaaatcatgacctaccaccagtgcttctccagccccagaaagaacataggcagaggcagtgttcaagaaggaatcgaccagctaacacagctcctctggttccaaccaataccccagagccacggtcaactgaacacaggttagtctgcacctctgaaattctagaaatagaacttctggtacttcctgatggtcagggtttctcaaatcactatgtacctcttagccagagctcaaagatgcacctcagaacaggtggggctgagctgcagctgaggatactatcaaaatgttacaggagggtggaaatttttgcggtattctcagcaaaggtaacagtgcctggcacatcagcaggtgctcaagaatttgttgaataagtgaatgactatctgggcactcagataaaaaaaaaagataccaatcttactcaaaaatagctattatgaagaatctcatttttcttgccttttattccttattctgcccttcattttcaccctaagagggctagaagcatcaaccctctggccccctgacctcaaagagtcctcaagtgtcagcctgacaaacactcagggacaggagtacccagtgccccccacccccactgctgtccagtgtccctcccccattgcacaactgtgcaaggcaagggaaagggcagggagggagtgagagacggagggaggcaagctgttgcaagctatctatagcaactgaaaagtcagtcgaagaaaagtcattaaccagtagcatctttgttctggaagcctgttgtctgtgccctgcccctgcctccccctgctccccaaaaaattctcaccttggacagttttcagagagaagccatggctgcctccctccttcacgagatagcagagccggggctgggtccaagtttgcacacctccattcatcacaggggaaagtatattatcactcaaaccttgctccttctgactttgacccaactctttcaagtccacccgtgttttcactgctttctcataggaatccccatccagaactagtaaagtcactgaattcccactctttctgaccagatccacaacctaggagggaagaagaaaaaggtaactttaataaccctctgccaactgccagagggaaatgctgaccatctggctcaatatctggccctggagatgctgctagttgacccttgacacccaagtagaagcaggtagttcctcagccacctccatccctgccctcccaagatccaggtgcagattagctgagcttctggcactgctggaatatagagtgtggttcaaccccagcccagagggttcttacaagactggtcctttctagagaggataagaacacaggccgctaagaaaggtatgtaagctcgggagggaggaaagaaaggggaagggggctagaggagattcggacatgagatgcattcaccctatgagttaaaccccagtctccagcatgggagttgacaattccattactgaaccatcagtgttccatgtagtataacctctcatgggtttaaaaaaaaaaaaaaaactctagtgttataagcaggcatgaaggggcaggggggatgggggtgggaatgttctataataggcttacacagatgtctttggaaaacagagctaacaaagcaacaggcacttagagaaaaggcttgtcctaaaccttctgttgtttgccaagggaagaaatcttggagtgaaattttcactttctctcttgtgcagatctctgtaagacacaaaagtttggaagacagtcattttgatccttgacttttctagagactcaaaagacgcatctgaggagaaaagctctgggtccctggaatgaccgtgccactcaacatgcctcctggagtggccaaagagagtgtagttaagaaaagaaatattggagtgaactttcactcactctcacctttgtaggtttctcaaaaacatatgaatttagaagcaagatacttggctttttcacatgactcaaaagaggtgtagaggaagagaagctccatcatcccacagatcttccagggtaacctggacacatccctaaatctccagctcctgggtctttgaaagcctgtttagggaaagaatttgtgattgtctcaaggttgagaggaaagagtttgggaaacaccaaggcatgggttggcaaaaagattacatcatcagtgaggaaatgaaatttccagaggtttttgccagatctgggaccagagacaaaggcctggatgaatttcctgtgtatttccatagaggtctgttatctagttgtatagagcctgtttcacaattaggctctttcaaatctggtatgttgatttaaatgccattataaataacttgataatgttgcctgacatacgtctcctatgcaaggctttgctctgggtgtcctttctgtttgctcggtgtgtctactcaagagtcctatacaaatctattttagaaacactgcttcaaagtccttccagagactcttcaaaattagatctagtgaaaccgcactcagtggagcattggtagttcagcggtggcattctccccacctacgcgggagacctgggttcaactcccggccaaagcaggccttcttacccttcatgctccaagttcatgcttgaagggctattacatttctagccaacaaagttattgtactacacaggctgtacagcatttaggggccttgagtcgtggtggctggaagctaaacctgccacctctggaatattctctgtgctggatctaatcttgaaattacatttcctctgctcaaagcctgtctttgaaagtgggggtgtttccggtggtttgctgcagtttggagtactgggaactaaataaagcctttgctactttcatctagtctccgggcacacccctgagtaatccaaaggccatcagacggattctcgtgctggactttcccctaccttaggccacatctcactatggagtgaggatcaagaagtaaaggtctgggaaggagagagctgcaggggccagggagactcttcgtgagtcggagagccatcagcggcccaaggaaaagggaggatcgtggggagacgaggggagcagtggagatgaggggagcagcggagacagagtctcacgcacaggtatgcccagacaccctgaacccagttacttaacctcgtcaaccactgtggcatccgcggggtccgtgggcccatgggtcttccgggagggattctgtgtccctgttattgtgtgtcaataggtgttagcctgatatttatatttttaatgagagaaaacaaactccagaatttgggaactgtttttccggttttgctttatacctcttggacactccttcgaaggactggatctgaggggcattggggtgcgactacggtggacaagggatgattaattttcatccaaaaatctttggtggattcccccggctctccagctcaccagtctaacagtagtttaaaacagaagatcagcaacgtttggagagtttttttttctttgcgttttaatgataaacttgatttattcaattctattctgaggttgtctttctatattttgagtataaaacgatggccatactatgttggaaccactaaggttcttctcttcacttgttattcgtaaagtctctttgtaatctgagaatttcctgagtaaactgggaactgttatacataattccttgtttttgaacattctttgtaaacaggaatcaggattgggggtggggagggagggaggagtgggagtcctgatttgtgtaacagaaaatcatggattacttatgtgatggagcaaaggtttaaaaactcttagcgtccccggatttccccttttactgtttgctgaagaaaattctgtctttgactcccttccttaccctctcctggcctgtgagctgcttcctccctattcagtttatttcctcctcccctccccgccccactcccccacccccgcagccccctcctctttttcagtgaagctgctggaggaaagtcgggtttgggagaagacccacacaggcaaggacagcagaacactgacatatagttacactcttgtcgccagcactgtcattaagatgttgtgaaaagacaaagacaaaagaggagaggaaagaataatatctccgtttcaggagatattccacaatattccaggatgttgtgcctactgtccagagtccttgatccgatgtagtaaagagctagggacattttcactgaaggctttgattgctggcaaaatctcattaaaagtgtatacattgataggttggccacagaatggccaaagaagagcctctggcctacatctgccaagatatatgtgtaagaatacactctgcagcattattttttattgtaaaatagcagaacgaatttattattcaataattataaaatgttcaaatgtatgtgactatattcggacaatgaaaaatgcagctgttaaaaatagacaatactgatgattcagatgatgttactgatgaaaataataacagatgacaattattgagcatttatgcaatcttacatgcattaccttatttaaagttcagaacaactaaggaaatgagtaacttggggcgggcgtgagaggtttggaggcacaaaaggaagataggcattcaagggacaccaggatagaagagccacagtagaagagagaggaagaggagtccgccaggtgggatgctgcaagccgctggatagcacggcggagatagggcgttcctgccccgcaagcctccctgcgaccgcaggcctccggccgccttcttccaggaagacgcgccctgctttcttctgatgttggtagagacgctgcaaagcgcatcgtcctcgagcatttcttctctccccaagaccctccgaaggagcatttcttctctccccaagaccctccgaaggaaggatgggcggacagactaagtggtcaaacgcgcagagctccagcttccgcaggagcatttcccgagtgtctttcatgggtaagagtgggccctgcaggataatgcctcccgttccctgaggagcagtgcgggagatgcccatgtggccagctcctgggccacgcgacccaggccctccaggaggagcgaggagtcctgggccctgagccagccccctggaccggctgtgccaagagaagcagcaagggaaggggtcccctcctgcctcagggtctctgtcctcctggggttaagagacgtgcatccaactccctctccaagtgctggagaggaggctaggtctttcccacgggctgggggccttgctgtcccaaggacggctggggaggaggaggaggccggttgagatatgtgaagcagctctggctacagcgggtagggagagggcgcgcgggacccaggagcctccgtgcggagccaggcctcaggagcagccgccttgttcctggaaggggtgcctccctccatcttgtctccaaagactgtagggagaccttctcgcccggtaggaaagcgacgtctcccatgctttcccaccacgcaggccttgtggcctttctcctgctagtgtctgccctccaacctgcgggggctgcggctgccacggttccacgctgggtggacgctgcctgcccgggatccaagagccgccgttgcaggcgggagttggggagtcgtgtgcaggtccgaaggagacccaagctcttggtcaaggcttttttgctatagccaaattcagcgtgtaaaagacagagagctcacatctgtctgttcgtaagcttcggtgagaacaccaaggaagcgcactcaagattcgtaggagggcgggaagggtccctggcggcgatatccacatcggcggtgagccaaggcatgtcaggagagtgagtgcgcgaacccagccgccggatagcgcaaacaccaccgcggacgagggccccgcatgtggagaaatcgcaggggtcagcggagccgaagtgtggtggactagcctcctccagggagaacccccttcctgaccactgtatgtcccccgccacataaggggagaggagggacagcacagcctactctcccctggccgacgatcagggtcaccaccttctcctctgctctcccctcgccattcttccaaaccaccctccgccaaagattccacggacagtcaccctcccaacaacccaggcctcctttcagcagcggctcccgccccacagccaccgcgccctctcacccccgcggttctgcccgccgcctctgccgagtctgtgcacttcacctccctgggtcccgctcccccctgagcttacagtggacgaggggcaggacggggggaaggccattcggctgcccttctagcttcagaatcacccagtgaacgggtttcaaccgtagccggcaagatgcgcctctccggttttccgaggctttggaacctgcacaattgttctgcaaaagacggtggctccgcctagcattggatgggcgcttgctctgcatggtgatgccggagcgagggtcgactgtccgtatgtcgcagtcgggtggtgtgcttgcttccaagtctggagttggctggttcaagctcgttctactgagcgtttcttgcattttaaaaatgcttaaaccgctggcaactttcttctacccagcacattctctcatggaatggcagagcaagaccaactttacccgcctctcctccgtgtctcccatacgacatgaggacgtaaatcaaggtccgctaggattctaggatctctctctctctctctctctctctctctctctctctctcgacggagtctctctctgtcaccaggctggagtgcagtggcgccatctcggctcattgcaacctccgactccctggttcaagcgattctcctgcctcagcctcccgagtagctgggattataggcacgcgccaccacgcccagctaatttttgtatttatagtagagacgggggtttcatcatgttggccaggatggtatcaatctcctgacctcgtgatgcacccgcctttgcctcctaaagtgttgggattacaggcttgagccaccgcgcccggccttctctctattttgtttgtttgtttgtttgtttgtttgtttactgtcattcatttagccctttccatacgcttttgaagttaaattggttctgtgattttatgattacatataatgttctagtcattcttgtacgggcattttcggcgttttcagccactggtgtatttctataggatagaggtgcaattactataggaagagcaattactccatcatagtgttcacacggtttttatatcattccattctctctcctctgttggcttattagctataactctttcttttgttactttagtaattcccttagggcttatagcaaacctttttaactgaacacagtcaaccttcaagtgatattaaacctcgccttctggccttgaagttattgctgacatgtactttgcttttacgcatgttataaacccacaacccattgttattgcttttgtttaaatggtcaaacttttacaaaagaaatttacaaaataagaaaatacctagtatagttacctatttctggtgttcttcatttcctcatgtagatctggattttcatctggtattggattccttctgcccggaagactcctttgacgtttctgtagtgtgggtcagctggtagtgaattcggtcagcttatgtaagtctctaaatgtccttacttcacttccagttttgggaatttattttttctggcagagtattctaggttaacttcctctgccctcagtaccttaaagatgttgcttctctgtctgctcccattgcattgctgctcccagtgggggccggcgagagcagaaagaaagttgatggcaattctcatctttgttcctgtgtaggtacaatgtctttttcttctggctggatttcagcaatgttattatgaggtatctagcagtggttttcttcatgtttcttgtgctttggtttcctcagctccttgggtcactggatttataattttcattatggttgggaacttttcagctattgtttcttcaaaaattggctgggaacagtggctcacaccttcaggaatcaggaggtgttgagtgaggccgggaattggagaccagcctgagcaacatactgaaaccccactcgtaataaaaataacaaagaaagaaaataaatgcttcctttcctccccgctccttttcagggactcacattactcataaattaggcctcttaaatctgccctacagttcactgataatcttttcatttaaaaaaaaatcttttgtctgtgagtttcattttgcatattttcaattattcatggttccatattccctgatcatttcttctgcaacgtctaatctgctgttaatcccatccagcgaatttatcatctctgatattttggttttgtcttgcttgcttgcttgcttgcttgcttgcttgctttctatctttctttttctttttctttttttggatggagtctcactctgtcgcccaggctggagtgcagtggcgcgatattggctcactgcaccctccgcctcctgggttcaagcgattctcctgcttcagcctccagagtagctgggactacaggtgcgtgccaggacacccaggtaattttttgtatttttagtagagacaggggtttcaccgtattagccaggatggtctcaatctcctgacctcgtgatctgcccccctcagcctcccaaagtgctgggattacaggcgtgagccattgtgcccggcctatacacaaacttttgtattagaatagaaaagttgagaaggtagttcacagaatggagtaaagaggatgaaatgggtttttggaaaccattcacattttaaagttgttttaggccaggcgcggtggttcatgcctgtaatcccagcactttgggaggccgaggtgggtggatcacgaggtcaggagatcgagaccatcctggctaacatggtgaaaccccgtctctactaaaaatacaaacaaaaaattagccaggcgtggtggcgggcacctgtagtcccagctactcaggaggctgaggcaggagaatggcgtgaacctgggaagtggagctggcagtgagccaagatcgggccactgcactctagcctgggtgacagagcgagactccgtctcaaaataaataaataaaataaaataaaataaaataaaataaaataaaataaagttaacacccctcacccccaaagaacaatgtgtgttctccccagacatccctttattaaaatatgcagagaaagtgtaggataaaagagcatatgctaaactcctcagaatgtgtgtctggaagtggacaggggaatgggagtgggatgaacagagaaaagaaggaaagacagtaagggccttgctgagagcagccaccataatgtgccctgagctaaggtacatgattaccttcttcctgtgcacctgagatctaagagaatatattaacaaatcagggatatggaatttcaaaaacactatgggaaaacaacaaatttacccaaacagaacagtctacttaagaaaggcaggaagaggccgggcgcggtgggtcatgcctgtaatcccagcactctgggaggccgaggcgggcggatcacgaggtcaggagatcgagaccatcctggctaacatggtgaaaccccatctctactaaaaatacaaaaaaaatagccaggcgtggtggcgggtgcctttagtcccagctactcctgagattgaggcaggagaatggcatgaacctgggaggcagagcttgcagtgagccaagatcatgccactgcactccagcctgggcaacaaagtgagactccgtctcaaaaaaaaaaaaaagaaagaaaagaaaaaaaaggcaggaagagattttataaacaaagcaaaaacacagaaatcatacaatgaggtggtgggaatgagactaactatgcccatcatctccaacataacactaattactgctaattataatggatctaagtctctcatattggatagaaaaggaaatgtggactctaatggttcaatggcagaaaagggttaaatattcaaagcagtgcacattattattattattattattatttgagacagagtttcactcttgctgcccaggctggagtgcaatggtgtgatctcagctcaccacaacctccgcctcccaggttcaagcaattctcctgcctcagcctccctagtagctgggattacaggcatgtgcgaccatacccagctaattttgtatttttagtagaaacggggtttctccatgttggtcaggctggtctcgaactcctgacctcaggtgatccgcccgcctcggcctcccaaagtgctgggattacaggcatgagccactgcacccagcctattattattattattattatcattattttgagacagagtctcgctctgtcaccaggctggggtgcagtggccagatctcggctcactgcaacctctacctcccaggttcaagggattcttctgcctcagcctcccgagtagctgggactataggcacgcgccaccatgcccagctaatttttgtatttttagtagagatggggtttcaccatattggccaggctggtctcgaactcctgacctcgtgatccacccacctcgacctcccaaagtgctgagattacagatgtgaaccaccacaccgggtcaaaagcagtgcacattatctttagcaagctaacacagaaacagaaaaccaaacaccgtgtgttctcacttataactgggagctgaatgcgagaacacatggataaatggggttagggggcaaggacaacagacactggagcctgttggagggtgggggttgggaggagggagagcatcagaaagagtagctaatggatgctgggcttagtacctgagtgatgggaagatctgtgcatcaaaccaccatgacacaggtttacctgtgagacaaacctgcacatcctgcacatgtaccctgaacttaaaataaaagttggaaataaaaaatgtaaaaaggaaagaaaataaacaacaacaacaaaaagaacggtgcaaatctataccacgctcattagaaacaaaagaatgagagtgaaaacatgaatatccgacaaaagtaaacagcaaaagaacgctttatgttaactagaggagtaatatcctagcatctacctagaatcaaatggaactgtttttccctgaactggcctccttgggtggccgaccagggccaggtgaagagaagaattctgggagtgaaatgtccatttattccctcttgttttggtctctgtaaggcataagaagttaaaagcaagatctgatccctggtgttttccaggaactcaaaagaggtgtaggaggagagaagctcaattatcaccctggtctcctggagtatcccaggcacagtcccaagagttcagcttttcatactcgagttcctgggtcctgaaggcctttttggggaaagtactgatgttcgtgtcaaggttgggaagaaagggtttgggaggaaccaagcaacagggaggcaaagagaagacatcaacaagcgaggcaagaactttccacaggctcacactggatacaggaccagagacaagaagctgggtgagtttctgatattttcctacagaggtttgttatgcagttgcttcagagcctactcagaataaggctttttcaagtcagctcttttaatgtgaagccataactttgtggtattgcctgatggcaattctccactgcgagccattgctctaggtgtcttttttgtttgtcacatcttgcaaagagaacacggtgaaaatcttgactcctgttcccaagtctgtgtcttaactctttccaaggctgcacagctcggggtcaggaggcgttggcagttcagtggtagaattctcgcctcccacccgggagacctggattccatttccggcaaatgcagcgtcctgtctttgtgccctgtgggttttacatttacttactgtgccgcgctaataaagaaaaaaaaggaggggaaggggggaactactgtatagtccttgggttctttccgtagcggaatttatttttcttttatttatttatttttgtttgttcgtttgagacagagtctctgtctggccccccagattggagtgcagttgcacgatcctggctcactgcaacctccaccttccaggctcaagagattctcatgcctcagcctcccaggtagctgcgattacaggcacgtgtcaccatttcctgctagtttttgtattttcagtagagacggggtttcaccatgttggctaggctgatcttgaactactgacctcacatgatccaccagcttcggcctcccaaagtggtgggattacaggcgtgagcccgggccccggagaggaatttatctaagccgagactttgcagagactgtctttgaagcagccagtgggtctgcttggtctctgcgtttctacgtatttggccctaaaaccggcgcgacttttatcgtctctgctgtcggatccctgcaatacaaagaggtacctggtcactgattctctacttggaccttggatagaccattagaccacatctcgcgatggagtgcggctcaagaaatgacattcccggccgggcgcggtggctcacgcctgtaatcccagcactttgggaggctgaggcgggcggagcacgaggtcaggagatcgagaccatcctggctaacatggtgaaaccccgtctctactaaaaatacaaaaaattacccgggggtggtggctggcacctgtaatcccagctactcaggaggccgaggcgggagaatggcgtgaacccgggaggcggagcttgcagtgagccgagatcgcgccattgcactccagcctgggtgacagagcgagactccccgaaaggagagaagctgtggggtggggcggacacaagcagtggtggggaactggggcccagggaaaggggaggcatgtgaggaggaacccgagtgcagatgaggggagctgcggagaggggcctcggaccttcctgtcgaggaaggcccagtctttggtggtctcggcaaaatgaagaatgggcccccagtggagagcagcacgtccccaaaactcatttctatcacccctgtttgttttacactccaccaggcaaatcttccgtccacaggattctttttaatacttctctttaagcagtgtggtggggaggccatggcaatcattagctctggaggcctgaggaggacactctgaagaggaaagccccgcgatcatccggtttcacccctgttttcatctactcttttcctcagcgaagcctatatgggttcccgatgtcacatcgcagctaccgcattggagggttaagagccgctgacaaatctctttcgggaaggggtaagaagcgcagctggcccagagccatggagagagacgcaagagcagaaccgaaaatacttttctccatcttgttttctctctgctgtcggtgaacattaaccttccacacacaccgggtcaatactgccttggtctctacaggaggtttaccattttttacagttcccgtaagccatgttttcttctcgcttctacagttcttccaggattgagtttcaggagctggtcagcagtccaggctagttcaacatcctggttcaaaatcgtttgtctggttttgctactagggtgaagcttgcctcctagaccagagttaagacgtgttccctcggcttctgttttctagagagaattgatatagtttcttccttaagtgtttggttgtgaaaccatctagacctggcgctttgttctggaaggttattaattgttgcttcaatttcgttaatagatagagacctatttagtgtatctatttctccttgtagagttttggtcaactttatctttcaagtagttgatccaattcatcgaagttatcaaatttgtgagcagagaattgtgcataatagtcctctactatgcttttaatgtccacgagatcagaagtgagggtcattgttttctttctcatattagtaatttgtatcttctcattgtttcttggttcaccagctaaaggtttatcaattttatcggtcctttcaaagaacactcttcaggtttttttgacttttttctattgatttctggttttcaatttccttgatttctgctctagtgtttattgtttcttgtcttccactcactttggacttaatttgctcttgttttctttgagtttcctaaagtgtaagtttggattattgattttagatctttatttgtaatatttaatttttaaaatccatgattattttactttctgtgcagtaatttttttagtgtactataatttttgttcttgttaaaatctcagttttttgttgtgtaccaagggtacaagtgtagcattgttacatgggtatattgggtccaggtagttcgcatagtacccaatagctagtttttcaacccactctccctccctccctacctacctcatggtagtccacagtgtctatagttctcaagtttatgtccatgtgagctcaatatttaggtcccattcctaagtgagaacattcagtatttcattttctgtttccgcattagtttcttccagattatggcctcctgttctatccatgttattgcaaaagacatgatttcattcttttttatgggtgtgcagtattccatgttgtgtatgtaccacattttctttatttaatccaccattgatgggcacctagtttgactccatgtctttgctattgtgaatagcctggtgtggtgatcataggagcgcatgtgtctttttgttttaatgatttacattcctttgggtatatacccagtaatgagattactggttgaaaaacagctctgttgtaggttctttgagaaatctccaaattgctttccacagagactgaactaatttacattcactccaagtgtttatatgctttctctccacagccttatcagcatctgttggtttttgactttttaataatggccattctgagtggtgtgagatggtatctcattgtagctttgacttgcatttctctgattattagtgatgatgagcatttattcctgtgtttgctggctgcttgtatgtcttcttttaagaagtgcctgttcatgtcaccttgcccactttgtaatgggattattttttttcttgttgattttttaaagttcctaataggttttggacattagacctttgtcagattcacagtttgtgaacattttctcccattctgtaggtggtctgttgaccctgttgatggtttcttttactgtgcagaagctctctcattgaattaggtcctacttgtgaatttttgtttttgctacaattgcttttgtggacttggccataaattctttgccacgtctgatgttgagaatgatatttcctaggttttcttctacactttttctgctttgaggtcccagtatatattgtgtcattgcaaatgacaaccaaccacagactaatcattacaagccaagaaagggaacttattggtgaccaggaaaaatgtccaacaaatgaaaattagtaaaagacattcctgggtgtctttttctgtaaagtgtggggcattgttgtctatagagttcagcaaactttttctgtaaagggccagggagataggaagtattctaggcttgtgagccaagaggcaaaattaaggatattatgtaggtgcacatataaccaggaagaaggcaaatttctataccattttcattgatgagattctaaactaacaatagtaactgagtagaacttctcaggtggtaaatgttctttgcattgagagcctaggctcaactttcctaggctccctggtacagccctccctttccacccctcaggctgtttccctccctgttttcctcagaagaagagttccaaacaaaagatctactaccctgagaagcggtgaagtgctcctggggcccaccaaggccacacaagtcaaggagtggatggccttgccccagctatggctcagatcacctttgcaggatgacatcttgttgggagatggtcatcagagacagggccatggaagacgctgtcaggaggaggtgagaggactggtgcccagggggagaagtggccaagcacctctgcattcagcctcacaaaaatctcaaggggatgtagaaatggggacagggtgaatggaaaactcaagcaaggttttggggccctgagctgatctctgtttttcttcctacaacctgcagcacatgctattttctcacctctgtggatggaaacaccatccttccgtatgctcagtctaaaaatctttgagttttctttgactgctgatctttccttcacatcctatagctgtttagtcaagaattcacattatgctgggcaatcaggtgttgtccttaatcgacaccatccttttcacccccgcccccagttaataaaacttgtaaagtcattctcctgataaagacaataggatttccatgaaattgcacaattttaatccttcctggatgcatgactcaagtaagagcactgcttttgtttactaccattttcccctatttttatttcatacctgtttgacccgcactctttcccataagccaggcacttcggctcaggtgtgctttcctaattgtagaatgagcaataatagcagccttgctaacaacttcttcctggccccaccaccaggcaaatgtcataggatttaataggtaaagaatcataggattgccaggcgcagtggctcacacctgtaatcccagcacattgggaggccgaggcaggagtatcgtttgaacccgggaggcagaggttgcggtgagcctagatcatgccactgcactccagcctgggcaacaagaactaaactctgtctcaaaaaaaaaaaaaaaaaaaaaaaaaaaaagaatcttaggctcgtccctattgcttggtgttataaaatgaattgttttcccctgaatttatatgttgaaagcttaacccccaacttgactgtatttagatatagagtctttaaggaggtaattaaggttaattagaccatacaagtggggccctaatctggtcagaatggtgtccatataagaagaggaagggcatcaaagaatctctctctttctccacacaggcacagaggaaaggctatgggagcacaaagcaagaaagtggccttctgcaagccaggaagagaggcctccccagaaaccaactctaccagcacattgatcttggacttttggcctctagaacattgagaaaataaaagtctgctgttaaaccacccaacctttggtatctttctatggcagcctgagctgactaacacccttggtaggtgggcagcattcaccttattgggctacatgatgagaagttaaagtaactttagcaataggcaccatttgatttcattgtatagatattgtgtcttttgcactgattttgccttttttagttgtgtgtatattgatgcctgggcctagcattacaagactagtcgaaatgggaagaaagaaaagaaagtgggaaagataccaagttccataattgcatcctctacccacatccagttcttagaatcttttccaatggagactgcaccttgtgtacactcaaattcaatctgagcgcacaatcatttagacaaccaaggcaacttttccaattttcagcatcacacgcttgggaaaacaagtatttcaatcactaatttaaatattcattgaggtaattattctgaggttgatgaaaaatatggtgtatccatgtactgttgccttctcctgggtcaagaatgttgtctttactctgctggctcacatttgaccagaaattggagtcccagcaaatcttactagccactcaggaagcctattttaagatagtcccaatctcaaacttgttctaagacttgtatgctgactgaggagaaagagcctcatgacaaaaattcaactagagctgtgggtgacagttgtgtgtctcactactggtctgggcccaggtttcccgtgagcacctaatgaatagactcaattgcagggatcgtcaagatgctcactatgtctacctcatagcctcaaaagaagtgataactaacagaatttgtgtagtatcctgaagggaaattaatccagatatagaggaaaagataaggattttttaaaacagacatgtgattcaacagttgtttaagatgcagaaagctgtaagagacagttgttcccactctaatgacaagaaaaagctgtatggtctgcaaaatcatacgtgctttgatcccaccagagagctgaagttgcaaggcccctgagtcagctgaagtccaaagcgtgagaaaaccccctatagaaggacaaacacatgaagcagttcatctttgacagataatggaaggaaaagatggcagccataaatgttcattggagaaaatcactgaagatttcatcatttcttaaaggccaagtgtgaactattgtgacagattagaaactctgagagtcccagatacatagcatggttttgcccatttgctgggtccttcctcccacgtccttagtgctgacaagacacatgtaacagggaaagaggatttctcaagcttgccacagtggcgtaggcataaaagtcatgatcacatgatcgaccaccaccagagtacaggcacaaaacctggttgcttctcacataaaacaaaaggcatctaccactgatgttggagctaggaactcgtccaacccttggccccagggatagggcaactgctgaggtagggttagacagaaaaactgtctgtattggacaaggggaggagacttgctcttgcccaagacttcccatcattgaaaggtagtgttccgctaccccaaggggatgtcacaggaacactaggacccaggtatccatggcctgaggcttgatacacattcagtgcaatcagtaatgtgagttggtttcgaccaatcatttgagttggttgcagaccctttcctctaatgaggaaaaactgtggtgtgggtacaaagtttccacgttcagaaagattggccttgtccttacagatattatattgattggatttctctcaacctccttaagttatgtttaccattattaaaattaagtgacattcacttggaagaagtggtaatacaaacaggttgtgagaatttatagtgatttttgatcccaagccttgtatcactgttgggtcttcatgtgtgtacttgaaaacaaaacatgtacaattgttgcactggtttgaagattttaatggtggaagtgacctaatcagtaatcagtactgtatctagaaacgaatcttggaaatatgtgattatgctcttttaaaatcgctgaaaagaaggctgggtgtggtggctcattcctataattccacactttgagaggctgaggtgggcagatcactgaaggccaggagttcaacatggtgagaccctgtctttactaaaaacacaaaaatcagctgggcatggtggtgcccacctgtaattccagctactcgggaggctgagcaagagaatccattgaaccttggactcgaaggtggaggctgcagtgagctgagatcctgccactgtaccccaacctgggtgacagagggagattctgtctcaaaataaataaataaaatagctgaaaagaaatgacagtgtgtttactctcactttgttcttgttttgttgtatagtatttaaataaaaggagattatttatcctcatactgaatttccaaaactgatatttgcatttagcattttgttaaatgatggagagaaaatttaattgtcttactttgaaaagtttggcataggttctgtcacacattttgttaaatgatggagagaaaatttaattgtcttactttgaaaagtttggcataggttctgtcacatttttgatgctttcgatcacagttctgtcattagaatgctggcaactagttatatgcaaggaatatcctaaccactttaatacaatggtttgaagtgctgcaggcagtaactactggacagcagatcacagtgacatgagagagagaaatagaactttctgcagtacaaatgtcctgtgaactaatccttgtgctattagcttacaggtcttagactcctgggtctgaaaaaggcacatacttctgctaaatcttgaatactgatgccaatgaatgccttgtcttcagaccctggggaagatgacaatcaaaatgaacttcttccatgagacacggaaccagaaattgaaaccattccatccctctaggcccaacaatcccacatgcacccttttccacctcatgccccctcttcctctggacagaagaggtgggcacatgagaattttaaggctggagtctgagagataagtttagttcagagactttcttttctttccctcttttcttctcttttcttttcttttccttccttccttcctctctttctttctctttttttttttttttttttttttttttttttttttttggtagacacaatgtttcaccatattgcccaggctagactcaaactcctaagttcaagtgatccacccaccctggcctctcaaattcagagatttttctataaattagactttacactcagaaacacactgatgcaaggccagcaactgggcccgtgtatcagaataacagggttttcttgagcattcatctgctttttcatagaaaagtataaaaggtcatgaaaggtttttgaaactcttaccttatggttgaactgattataattaaatttgtgtataaggtttcattaaaattagctttaacattttaatacatcacacaaaggcaaaatttggttttctcttgatcaaaatgtttgtgtaatattaataaaaattattaattattttgaaaaattttttaaaaatttattttaaattttattttaaaaaataaaaattattaatattaataaaataaaatatttttgtttaccttttgcctaaatgattgactattttaaggtgacctgtgattctattttgtgatatcaagtctctcaaaactttggctaactttctaagagtaaaattttcatattgagccttttgggcctcaaattaactttttggatattaggttcttgaagtccaagagagatatattaggcttcttaggcttatttgttatgtagaattctgcaagaagcattgtcaaatctgaggtggtgtttcacttcctttgggttctattgacacagatgtgttgttaatgtgtgttccaggatagtatgagattcctagagttctgctatgctgtcagtaataattatgattattatgttaaattgtgtgtgccacagaagcaacagaattcccttgtcaactgtgtctataaccatggctgtcttaaggcttttgttatccacaattgttgttttgctttgattcttctcaaaaagtgacttataatcagttacagtccaggccttgcttctttggggaagtccacgaaaaggactcttggatgcaggtttctgataactttggagattgtgccattgaagtaaaaagaaaatttcacccagggcactaatagaaaggctgatatgttcataaagattgctagcccactatgaagcagagcaggagctgattgtatggactgaactaatggaggactgaagtaagtttttatggtctttgtttgtttgtttaaaacattgtttattcttcaaagcctggagaacttttgtcattttgagctatttatagcctgcaacaattgagtagaatagtcttctaaacagaatttgaggcatatttttctctctctgccgaatttctccagaatttgtaaactgaatattcttaactcatgatgatgtgtttgtttgcataagttcaataagattctgttttcttttataacaggacacaggtggaggaactggtaatcttctcagggctttgcctgaaatggtgttgtgaaatgttccagcaaagcccatttaggagagcctatatggacaaggattcttgctgcactttgtgtgggtaatcaggccaagtatatgggactgaagcttcttttgcaggtaggttggtcctgctgtgttttgtctttagtggaaatggggaactggacagaggaagattgtgtttcaggagaaactacagtattagatgaatgtttgattcctgggtggccatgcggtcacccatggtgtggagctgctcaggatgccccttctcctcatgacaaagccagaaagatgcatgaccagattccccatgattgaggaactgacaaatagaaagtggggactgaaatcgacccaatagtcccacatacagtgtttttggatagacttaaaaatggacccttctggtcttaaagcttgaaacttacatttgttttatctgagttccttcctcaggaaaggaccctcagcctctcaaaaagcatcatagacctgaaactcagcagatcacagcatccagacaatgacttgccagtcccttcactcatcatgagtgcttcctcacccttccctagttcctcttttcccacacacagttacgtttcttccctgctgtataaacccctcgttttagttgatcagggagattgatttgagactgatctcccatctcctcagctgcagcacccaattaaagccttcttcctcggcaatactcaatgtctcaatgattggctttctgtgagctgagcagcagggcctagacggaactcctgggctttcagtaacgatgcatgtacacttttaaacactgcaattaatgggtcatgagatattgagaaattggaatggcatcaacttggccaattctgagaaaacacactgtgcttaaatgtcagggccctgcctcctgacctcgacagtatatggttgattttgagtcatagcaggtgagtatggcctggtttcagtgttttatagaaatataaaatatggctgatcgcatttattttaaatccaacaaatctccatttctggtgagaaaatttttttaaaaccaaccaaacaaacaaacatagaagaatatgaataaaaaaataagggattccctgcttcccaatctcacttgattgctgtcttctgttatatactaagggaggaagggggcaaggtgcccaggaagtcccacgtcctgttttgataatcatctggcctccttgggcaaacagaaaacagggaaagcataaagaaaataacagaaattttgcagaaatttcatctccggtctgggcgcagtggctcacgcctgtaatcccagcactttgggagcccaaggtgggcaaatcactgaaagtcaagagttcaagaccagcctggccaacctggcaaaacctcatctccactaaatatacaaaatttaaccaggcatggtggtccacgcttgtaatcccagctactgcggattacaatcacttgaacccagcagacagaggttgcagtgaggggagatcgcccactgccactgcactgcactccagcctgagcaacagaaggagactctgtctcaatgaaaagaaagagagagaaagaaagaaagaaagaaagaaagaaagaaagaaagaaagaaaagaaagaaagaaagaaagtgagggaggaagggagggaggaagggagggagagagaggaaggaaggaaggaaagaaggaaggagggaagaagggaaggagggagggagggaggaagaaaatgaaagaaagaaagagaaagggaaagaaagaaagaaaagaaagaaagagaaaaaaaaaggaaagaaagacaagaaagaaagaaagaaaaagaaagaaagaagagagacaaagaaagagagagagaaagaaagaaagaaaggaagaaagaaatttcactgtggcacaggaaactctatgaccgaggcttcaagggctcttctctggccctaaactcacagtggattttgcctcattttccgaggtgcaaatgaaatgatggaagtcgatcaaaggagagggcagagagaaagcaagaaggatggctccttcctgcaggtccaccttcctcgagtgttgcttgtgggataatagaaatgccttgacatggttgagtgggaactattgctacttattgggaattcagacgcttccggcaaacttgcacgatgaggttccatggtgtaatggtgagcactctggactctgaatccagcgatccgagttcgagtctcggtggaacctttctgtttaattaggacggcaatgttgtgttttactccctaaatggaatggggattccgctgacgttcagaaactctgcgctgtgggcctccgtgtcccttctgctcccgctgtctgagcctcgcgatgtaccccgcgctcctcgtcccctcttcgtctccctcttcggtgttcggggtcccagaaaccgggttctcgcagtggcccggaccacagggaaattgccgagtcatccagtcgggatcagcgagcctgcagggtccccttcctgggcgagcctcctggcacccagcaatcggaggcccggacacccccgccagggacccagcgacccaggaagtccccaccccctctcagagcgaccctgggcctcgggctgacaggtctcctccactaaaaaggctgctgcccctctatcctagaccccgagattcctttcactcgggaatctcctaatggcacccattgtctttttggtaagtaaacggtggcgtgagaaattctgatggggttagctcagtcattggagagtgtgtctcagtttaggatcgatggttccagacctaacttggcagtagcactgctttattcagatggcccatccgattccgaatgttaatttgctctgttcttcatattcagatttttatgccgaatttctagctcctgcgtctctattgcgggccctaaaagtcgctgtttcactaagctttggaacctgactccgggaaatctcattctttcgtcccaagatctcagccagaaagagagatccgcgcggcggcatcttcaagcgcgcgggctgggagcgcgggttctgatcctgggtcgccccggccgagctccctcagggccacggggaagaggaacctgagcagctctgaggggcgagtctctgaagatggggctcccccttctcccgtcaggaccctgccccaaggagaagacgccttagttaaaaatgttttctcctgctcttcagagcacttgggatgaggttcctgatgggtcttgggagcgaactaagatgtcactccaggcgctcaggaccatcgctctcattttcatattttggggctgagagcggttacgaaggactgaaaaataccgcagtctttgaggggctcagtttggaggacgagccggggttgaggggggttgacgccttcttggctccttggagtggactggcaggtaaggaaacacaaactccgtttccccttgcgggcagaactgcaggacctgggatggaaaattggacagtcaaagagtaacgatatttatgtagaggtgggttgcgtgcattaaaaattgttatccctacagataagtgtaggaagggaccagggcactgctgttcaccaccagctttgcagcatatgtaactttgataacagtgtatagtgcataaaaattcattcctgtttacaaatatttgatcacaaccagttacaggtttctttgttccttctccacttccactgcttcacttgactagccctataggaaaaaagaatcattcttaaatatgatattgtttcagttgatcgccagcccacccgttcccctccccctgaaagtagctgggacaacaggtgtgcaccgtgtgctgggctcatttttgtatttttagtagagatggggtttcgccatattggccaggcagctctcgaactccagaactcaagtgatccgcctgcctgggcctccctacacctccctgctgggattacaggcatgagccaccccacttggccatcatttgtattttgaatttaaatattttgtagtcatcactcttcaaagattctgggttttgctgcatgtgcatgatgggattcaggacatgctactccaaagtataacatcttggggtattgaatattttatgctaaaggaatatgagtaaaccacagaagcaggaaggtcactgtcaccctccccctgcccttcctccctgaagtccagtataagactcttatgtgagaggtgccctctctgtacccagaggaaaggtgcatccttgattctgaagacacagggacacagagaagagcctgaacacagaggcctggctacctttcccccactttgttactgttagatcatacttttattgacttatcatacttctccatgactattcattcttgaataaacctactgttaaaaaaacgaaaacaaaaactgaggtttagctgtttccatgggccttcatttcctttggaaggcgttcctgtcatgtaaaatttacattaaataaatctgtatgctcttcccttgttagtctgtgttttgctgtgagggtctcagcagcgaacctaggctgggtgaggaaaagtcatatttcctccccgacatgtacaaatgtcttccactgtaaagctatatgatttttttttttttgacagggtctcactctgttgtccaggctggagtgcaatggcacgatatcagctcactgcaacctccgcctcccgggttcaagccattttcctgcctcagcctcccaagtagctgggattacaggtgcctgccaccacgtccggctactttttgtatttttagtagagatggggtttcaccttgttggccgggctggtctcgaactcctgacctcaggtgatccgcccgcctcggcctcccaaagtgctgggattacaggcgtgagccactgcacctgggcaaaactataagaattttactggggcagatttgaagcaagaaattgaatcattattcccctttggatgagctgaacacatgagctaataaactcccagttcctcccagatagaaatacttctctagttcattccccgaagctccttgagggtcaaacctgctggagattgaggggccttcctgggatctcccagcccaggaggttactgctggtgagaagattgctgcagtctccctgggagggtgcacggccactggaaagtatcactgctgtaacttcaatacaactggttttcgtcacatctgctctttgtgcagtgttgcaggcaaaatacaagagctaacatgcacatgagtaacacatgcacatcatcagctgtgtctgcaacacaaagtgccacatgtcaggcacagttgattatgtgcatgtgtttactcatttagtccttacctcaggccgaggtcacactatcaccttcatcttccatgtgagatgcacaaagacgttaagtgacctgtccagggtcactcagccagcaaaggaggatttgaaagcaggaatttgaagtgaaggcagcctgtctccagaagacattctcagaaccactgcatttatactgctcctaacaaaaccaccgttgcaaaaattatgacagtgagaaaaacctgacataggaaaactatgactgtgaaagaaatctgacctaactgactgcatcttacttctaacctctgagctgcctttgtccgttcctgggcataggccaggctaactatgagaggagtttagttccaagtctaagtctgaaacaaagatgtcttcctgagacaaactccttcctatcttggggatcagatctccttagcaaagctaacaaattaggtgcgagattggaaattatggctcaggagccatgcagccagaagccacatgattcctaagctccccaactgtgcctgtatataagattattggtgtcaaacctaagattggtgttcaaggtatttttcagaccctgccttatgatggactagctggcacacccagaccggtaaactggctcatctggtcctgtggcccccactcagggactgactcagtgcagtaaacaagctctgacactgtgatttcatccccaacccaaccaatcagctttgcacattccctagccccttgcctgccaaactatccaaaaaaaaaaagaaaaagaaaaaagaaaaaaaaaaccctagtctttgaattttgggggaggcagatttgagtaataataaacccctgtcctggtccctcagctgcctctgcatttattaaattctttctctattttagaaagcctgctgttctcagctccattggcttacctgggcaatgggcaagataaacctaccaggcagttacattaataaaagagaaacacaaatggtaagcatgcttgaaaagaaatataagtctgtgtatttctttggaagaaacacaaaaggaggaggaatgataagacaggcaataaatacactgtcctaaatattttcatgattctcctgcctccttcgtatccttcttatcccaacaacttctccccagaaaccttcaacttaaacatggtcctgccagaactgggtttgtccttccctttacattttcctctcacctaccctacaccccttccatatctaatctgttctttaacttccaggtcattgagaattttccatttaaaaatataaaaaattcataaagcggaagataaccagtcatccatattcacacctcctggaattaactactattaacatacctacatatttttcttccaaatcattgttaaactatacatgctaagcatagaccatactaacagtagagaagatgtaaacatatgtaaaatttttgaaaaccttacgttcaaaaataacttctcataacatttgggcaaccctggagttacagtcttgtggtacatctacagggagaagaatgtatattttagctagactgtccctatccctaaaagaaaaaggaagaaaaaataataaagaaggatatatatacttgaaaaaataataaaataataaagacgcatatatgtatgcttttataaaatttagctgagactctatttttattttacaaacattccatttaatagtgcatgaacttaactgcagacaaagagacagaaacagaaacgaaggaattcctcaactcccgattacagttagagagatatttttctaaaggaatcttctaaggataaacgtacactaaattaagtagaagacattaagatttggagtggttttcttattcccttttacaatcaggttgattaaggtgtgagttgactttggtacaatgcatccatttcaagtttgatgacgtgtctattactctaaaaggtcctcttgtgccctttgcagtcagttccgccctccccctgaggccagcagtcaatgatgtagtttctgtcactatacaggttagttttaactgttgtagaaattcaccttgatggcgccacacagggtgcactcttttcatcactcggcataatgtttttgagatgatccacgctatttcatgtttccgtaatgtgtcctattttattgctgggtagttcgggtagttggggtagatcgcagcacattctggcgacaggtgagactgcggttctgacctgcaggcctcggtgaacatgagcaagggcacctgggcgccgggagagacctcccttcccctacagaaagcaagcgtgttatgttaacaaccgaacggggaccctgctttcatcccaaagaacagcacccgactgcgtagtttcttccctggctctaggaggtgagaacacattccccgctagcacagacatcctacaaactcctgcggaggctgcggttagaagcagaggctgtgtgaagggtgactctgggggctatgaaaaaacacgaaggttttcacagagcatgagaacccaaaagactggagactatgaagcgatctgcaaaaagcagccccaagtagaaagggaagagaagagccctgcggccacttagtgttaaaagagctcacggcggcggagaggataacacgttactttctgtttcccatcattgcgactgtaaggagaacacttaacatgccacccaagccacaaaactgcagttttaagaataacccttataggggagtctattttttcattacaaaaattcaggggaaagcgcggacgcagtcccccactaccacaaattatgcagtcgagtttcccacatttggggaaatcgcaggggtcagcacatccggagtgcaatggataagcctcgccctgggaaaaccaccttcgtgatcatggtatctcccctgccaggtaagtatgacttcacacacttctgccctgtcacagctccatatacctcaccctttacacacatggtcacttgccccgcgcacccccgagccttcctagccctgacacacagctgggaccctcaggtccgaccagcggtcctgaacccgctcccacggcacgggagctccttcgtggtgaaacagccagtggcgaagcagcagcccctgcgctgcctcatctacatagaagtcgccctatccgtgatgtcaccgacagcgccttcctcgtcccggtctgcttttctgccccaccctccgccactcagccgaccaacatggtgccagagcctgcgggggcagtgatgtctgcctctgcctcctttccctctcttccccgcccatggtcttccccaaagaagcgggtgtttctgttgtagttttttgtttgttttttgttttgcgccgtctcgctctgtcgcccaggctggagtgcagtcgcatgatctcggctccctgcaacctccgcctctcgggttgaagcgattctcctgcctcaggcttccgcatagctgggattacaggcacacgccaccaagcccggctaatttttgtgtttttagtagagacggggtttcaccatgttggccaggctgatcccgaactcctgacctcaggtaatccgccgacctcggcctcccaaagtgctgagattacaggcgtgagccatcacgactgcccagaagccggttcttagcctgtgttgccgaggacctctttggcagaaatctggagcctgtccacccttcttcaaataatggcttgtaatgcgcagactaaaacatggaggattacacaagaaactggttcacttcacatcattatccttgtgatgtagcattctacttgaaattggaagccgttcgatatcagagaaaccatatctatgaaactagagaggctgctcagatgactgcaaaccagccatccttacttgttttaccactagtagtgttataaggacggtggtccaatttcaggaatcttgtagggttctttcaaatacagcaatgtacaaatatgctgccccagcagagcacactggacactcgggcatgatgctggagtttgtcatctcttccacggccttctccagaccttagcacttacctcatgttaacactttatgttctgcaaagacagaaacaaagtggtccaaatttagaaaaaatatatatatatttgggggaaactttatttgaggtgcttaacagattacttttaatctgtagaatacaacaccaaactctgacaatactccacagactccaaatctatcaggcaagtttttcctgtcctttgctttcatataaactgaatcataaagtgtatagtgggttttgggggaatataactgcccaatgggttcatgttgcctgctgcctagacagaaccaatttatcaagacaggggaattgcaataaagaaagttatttacccagagccagctgtgtgagagaccagttttattattacccaaatcagtcttcctgagtattctgggacccgaatttttaaggataatttggtggctgggggccagtgagttgggagttctgattggtcaggtcggagatgaactcaaagggagctaaagcatcctcttgagctgggtcagttcgtgggtgggggccacaagatcagatgagctggtttatccatctgggtggtgccagctgatgcatcaagtgcagggctacaaaatacctcacgcactgatcttaggttttacaatagtgatgtgatccccaggcacaattcagggaggtttagaatctcataagttggaggctgcatgatcctaaaccatcatttctaatcttgtggctaatttgttagtcctgcaaaggcagtctactccccaggcaggaaggggatttgttttgggaaagggctgttatcatctttgtttcacagctaaaccataaactaagttcctctcaaagttattttggcctgtgcccaggaatgaacaaggacagcttggatgctggaagcaagacggaagcagttaggtcagatctctttcgctgtgataattctcccagttataatttttgcaaagtcggtctcaggagcagaggcataggtttgacttctttcactcagtcttacatctatgaatttttcatgttattcatgtggttatttgtttctgtgtgtattcctttgtatgaatataggccaatttatttatttattctactgttgctgaacatgttgacctaaaagaaagaggctgaagcacaaaatagaatctagagtttacttgagccaacatgaagacagctgcctggaagactcacaccaaaagaaccttggatctgagctccctttggcctttgtcacaagcaggtttttaaaggtcaaaaggggggatgcacaatgggctgacagaaaggtgcctgtcaggaattctcattggttttcagaaatagcattgatgagagcttggctatcccttgttatagggtgtgggatacagtgtttggtgtggcattattagattaatttacagctacctggggtgatagcaagcagttgcaacagatgaatacatagctcaaaaggaaggaagcagaaagtggttgctgtcttgatttaatgtctctctgatcatgtgaagtggctcacattcctcagataaaaattcttttaaaaatctttcttctttaaagcatagatgatcaaaagctcagccaaggtgtccctctttgccaggaacactcattcccggatagtctttcccacagtgagggcaggggaggaaaggagctgcctcactgaggaatttttaagagcgccccaaagcccaattgaaagtacgtcacagagtagaaaaaaaaaagaagaaaagaaaagaagagagagagacttcagttaaatctacagctgtcacttgtttaatcatctctcgtcttcagataccataaaatcagttttctcagaagtaaaacaggaaatatataacattaataatttgaatagcacagatataattcacacaagaatgagaatcacaaagagaatccgtatgccagaacagtaagggaacctattccattagggagccaacgaaaaaacatcagggaaaacatcacatcccagttcttctttcatgatttcttgtagccaaatgacttctaattttttctagatgaggttctacgtcatgggagtatttatttttgtatacgcaacaagaggttgtaaacaccacacatccacctccctgctcagctaaatctatcatctaaagcgggctgcggaggctgctgttgctggggctctccccttggtgttctgggctgcgttgtactaagtggagaaggtggttgtgggcaagcgttgtgcagagatcacaaccaggtgggcagggggctgctctctccacactatcacttgacaatgtacaattccttttatgaactcttgtaagtgctgctgtatctacccattgtttttgttttgttttgttttttgagacaggctctctctctgtctcccaggcgggagtgcagtggcacaatctcggctctctgcaacctctgcctcctgggttcaagtgattctcctgccacagcctcccaagttgctgggactacaggcacacgccactgtgtgcagctaatttttgtatttttagtagagatggggattcaccatgttggccaggctgatctcgaactcctgaactcaggtgacccacctgcctcggcctcccaaagtgctgggattacaggcatgagccaccgtgcccaggttctaaccatttttaaataagaataatattgtctttgaaaatatatatcatctaaagtaatgcaattatctagtacaatcttagccagtgaataaatagctttttgttgagctgtgaaagaggctacagtttcatcagcaatatttctttctttctttctttcttttgtctttcttctttttttttttttttaagacacagtcttgctgtgttgcccaggctagagtgcagtggtgcagtctcagctcactgcagcctcaacctccctcgctcaagcaatcctcccacctcagcctcccgagtagctgggactacagacatgcaccactatgcctggctaattttgtttttgtttgtttgattgttttgtttgtttgttgaaagacagggtctcgctatcttgctcagaatggtcacaaattcctgagctcaagcaatcctcccagctgagcctctcaaagtgctggaattacaagcataggcccccaagcctggactctttatttttctttcagagagaaggagtggctctgtcgcccaggctggagtgcactgtcgccatcataggtcactgcagcctggaactcctgggtttaagtgatccttccacctcagcctctgagtcactgggattataggccagagcccccatgcccggtttttatcagcaatgttacctaaggttaaagaaggatttcgaaccacgggaagcaacatcccatcaaagcaaaagcgtgctcccccaaaaatgtatggagctactttcttaatggtcaggcaggtaattagcaagttttctcccaataggatctccatctattaataaaatagagtggtgggcatgcctagtgaaaagtttgaggacactcatccaattcttttttttttttttgagatggagtctcgctctgtctcctaggctgaagtgcagtggcatgatcttggctcactgcaacctctgcctcgcaggttcaagtgattctcctacctcagcctcctgagtagctgggaatacatgtgaacaccaccatacccagctaatttttgtatttttagtagagacggggtttcacagtgttggccaggctggtcttgcacccctgacctcaggtggtccacccgcctcggcctccccactcatccaatgttgggtttcttcagagctatatatatatataggcatgaccaaatatcctaaaagacattgcacttcatcattccatgtctttagacatttaagggccatggatggtgatctcctccacagaccaaataaatgctggtgcacaacaggtaagtgtagtataatttgggtacatcagctttcggcatttaaaccatgcatgggtcagacatgttagagcaagagggcaggttggatcctgatagcaggagggagtgtttttctcttaactttccaatagcatcatggtgtttaccactgtcatttcagagtgaggcaacaattttttgttcgttttctttctgatctttggttttttttgcaaccggggtctcactgttgcccaggctggaatgctgtggcaacatgacagcccagtacagtcttgacctcttgaccttcagggctcaatgaatcatcctacctcagcttcccaagtgctggagttaggcacacaccaccacgcccagcttatttatttactttctgagacagggtctcactcttttgcccagtctggagtgcagtggtgtcatctggattcactgcaggctcgaactcctgggctcaagtcatcctctcaactcatactcctgagtagctgggactacagttgggtgccaccatgcacccaactgtatatttttgtatattttgtagagattgtttcaccattttgcccaggaagatagtctcaaactccagggctcaagtgatcctcctgcctcgatctcccaaagtgctgggattacaggcagttattttgacagtacaattatgatgggttaaactgagacgtacggcaggaaggttaggatgagtcagacagattcgataaacaggttttgcttgatgtaaccccgagttgcatcgtgagttcaatcaggaggaatacaggtgaaatttggcacaggatgtaccaatgggtcattatggtcaaaagtggttggtggtttaaggtggcaaacccagcaccttgtcacatttcccacagtggcaatggtttgtgagattctgatcagagaattatccctccctgatgtaatcaaattaattaaggacagtaaaacagaaatctgatcataggcattttgctatgtatgtatgtatatgtatatacatgtacgtgcaataggactagtgtgtcatatctttagagaatatacatataggctgattttaccaaaaccaataggatacgacccctacaacttaaaggagccctgatggtgtatgtattccagtcaagagaaaaagagactaactcttccaggtgcagtgagcactggaattgtgaacagctggttatacaggccagtatcttgggtggaagtgggctacaacagatgtcagctacttgccatcttcgtcaggaagatggcaggtcacctttaagtgaaaacctccactgacagatgtccactctggtagggttgccttttagatatgagaaacatgaatctgtgtgtcaatgcccttatatttactgccacagagattaggcaataatacctgatgtgagccaggtgcagtggcccacacctctggtcccagctatttgggagactgaggcaggaagatggcttgaccccaggagataaaggctacattgagtcataattacgccactgcattccggcctgggcaacagagtgagaccccatctcaaaaaaataaattaatattaataatacctacgtggtgccctccagtggacttggagggagtattttatttgatgttgtttccagtaagcgacatctccagtttataggcatagtttttgatattttcatctcccatcagctcattatgaaaggcatcctttattaatttggagctcttcataagaagttttgtgagaccttagaaataatggagaatgttacctttaagaagtgcagtgcaggttcataagccccttcatctaaccactgcatgggtcttcctgttctaatttcaaagggagggagtgaaagttttccagaaacagtgggggatctttggccagggaaggttaaaaacttctgttagctttgccaattgagtttttatcttatcattattaagttgcactagtccagaggattaggggtgataggcacaatggaaatgttgggacataggtcaaacgttacaaatggatccaactatctgactgataaggtgtgttcctcagttgctatggagatcagatggcactccccatgaggaatgattttctctaatcacagtctaccagctgcttgggctgtggctcattggcacagaaatgtttcactccagcgacagcgcgtataaattagcaccagaaagtatctgtgaccctgagatggagacagctggataaagtctaactgccatgtctcaaaaggtcctaaagatacaatgtccctgtgacacatgaaggggttttccaggattatgtttgggacagaacagaaagtacagcaagaataaaccttttgcacaatggtaggcgatgattttcaatacactgctttccccatgctatcattttgtctgaattccaacgagtcagcttatgaactactttaaaatgggtaattgaagcctaaggggtggatcagggtatcactgggcccataccatatgtgtgtttctggaaaaaacttgttccctttatctttccagagaaaataaaatattgactcaaaataaattaattaaattttaaaaagaaacagggccaaccatggtggctcatgcctgtaatctcagcacagctctttgggaggccgaagcaggaggatcacttgagctcagcagttggagaccagcctgggcaatttagtgagaccacatctctacagaattattatttttcttaatagccaagtatgatggtgcatacctgtagtcccagctacttggaaggctaaggtgggaggatcactggagcccaggaggttcaggctacagtgaactatgattgtgccactgcactgcagcctgggcaacagagaaagaccttgtctcaaaaaataaaataaaataaaatgtcttagaagtttagctgtccatcctatgcagcagaatatctatgtgtcatgtccaccatgtccttctgttgtatcatccccttagttaagccaggaaggcacctgtccccttattagaatatcatgggctcatggctagcacagtggctcacgcctgaaatcccagcactgtgggaggctgaggcacatagatctcttgagcccaggagttggagaccaacctgggcaacatagcaaggccctatctctacaaaaaaaaaaaaaaaaaaaatagctgaatgcggtggtgcatgtctgcagatccagctactctggaggctgaggtgggaggataactagagcccagggggtggaggctgcagtgagctgagatcacgccactgccctccatcctgggtgacagagtgagacctagtctaaaaaaagcgggggaagggggagaaagtttgttgtgccagcaagtaaatgaagaaagggacagtattagagttgagaaataaattggaatatgatttgatacctctcccgcagaagataaatttgctaaaagtgctgaagttagaggcattacataagacccgttgcagttgctcatgcctgtaaatcctggcactttgcaaggccgcggagctgcttgagcccaggagtttggagaccagcctgtgcaacatggtgaaaccccttctctacaaaacaaataaaaattagcagggcatggtggcccactcctgcagtctcagctacttggaaggctgagagatgggaggatcgcttgagcctgagaagttgaggctacagtgagacgcaatcaggccactgcactccagccttagagacagaatgagaccctgtcacaaaaactaaaaataaaaattaaaaagcctgtaatatagcagtggcacatccagttctctacgctagtatagaactatcagtggccaaagatatgtgtacaagagtgatgatttcaggattctctgaaatcctaaaaccatgaagccaaccttatttcaaacacattttgaaaacggttaaataaatcatgcacaaactgactgataaaaaaatgctgttttcaaaaatgatgaagaggattattatgatgatgaatgattccactttctatccatagtattgatagagcaaccagtaaatccaggcccatcctggggataggatatctctctaggcctcctattaacaatgaaaaaattaaggttggcatataacccatccaagcctataaggggcagcatgaggattttgtcggcaccagaagtgactcgtttggtctctgtttcttgtacacaggcacaagacagcatgacatttcaggagattctctgtctgaatcggatctgtgaggcgagggtgtggggagtgtggggaatggcccttgacagggatctctgttaactgtgcctagaatcctgagaagataaaaccttccctgcagtaagcatccctggctggcctggaacctataggacttaggactatgggaagaaaaagggaagattctctagtgatcgataatacatgaacgggggagattctctagtgatcgataatacacgaacgctttaaaagctagagcaagcgtccccgggtgggctcgaaccactaacctttcagttaacagccgaacgcgctaaccgattgcgccacagagacaagaactactgcttttactgtgcgctatgggaagggcgccttcaacaaatttcccctgtgccttccagcctcagggcttgtccggcaggatgactgagcaaggccttggaaaaccggagcgattagagcggtgaatcgcgctggtcacgttggacacctgcgcgttaggagattctggagccagaaggacagccgaatggccttcgcccgccctgcccctcgcctgcttcagaagcccccggaaacgccccggtctgcgacccgggttcgagcagccagggggctcaagggaagctgaacgcctggtgggctcccgggatggctcttcccgttctttgcacagccttcacccagtgagggagcctgtgccctccctgctcagtcgcattcggggcgctgcagagcttccgctgccttcttcggatcctgcgttcggcaccggggctccaccagggcagggatcgtggtgagggtcgctcgtggatcccctcgcggggagcagggtctggcactcaccagggcgcacgactaggacttgttgaatgaatccgtcgtcgcctttatcttttagtcctttgaagagtcttgagaatggaaatcatgagagatttttccatgggggaagttctttttacgaaacgtttattcagattgatttctcggcaccccgcggggcgggcaacgggcagggcttccagtgcaccttctgcgcagtggagccgcgggggctcagctggacagtggtcgggtcgtggggctggagggcgggagcgggggaagggaaaagcaaaagcggggaaagaagccggagagcggtagaccagacatctagacctgaaaggctcgtgcggaggcagaggcgggatcttccggaggtgagaattgtttttttattgtagcagaatggggaggaattgaggggaaaacggagatagaacctgaaagagccccaaacgtgagaatctgtagctccccaagaataagatcttccagaaaaattagaccgaaaactaggcgtctgggaaccctgacatccttggaggagtagcatcatcatgaccctctgtgttccttttggcataaggacttgcttccattgtttgtttgttaaattgttgtgtttgtttaataaataaaaccttttcatgtatctttgaaattacgttggtttggccgagcgcggtggctcacgcctgtaatcccagcactctgggaagccgaggcgggcggatcacgaggtcaggagatcgagactatcctggctaacacagtgaaaccccgtctctactgaaaaatacaaaaaattagccgggcgtagtggcgggcgcccgtagtccgagctactcgggaggctgaggcaggagaatggcgtgaacctgggaggcagagcttgcagtgagccgagatcgcgccactgcactccagcctgggcgacaaagggagactctgtctcaaaaaaaaaaaaaaaaaagaaagaaagaaagaaagaaagaaagaaagaaagaaagaaagaaagaaagaaagaaattacgttggttctattactttatgattacaaacaatgctgcagtcatcattcttgtacacttctcattggccactggtgtatttctataggatagaggcctggagagcagctgctccagcatagtgattacatggttttttatatcattctattttctttccttttttggcttattagctataattctttcttttgttatgtcagtgatagctttaaggtttctagaatatatctttatcagtctgccctcaagtgacattataccttcccttctggcctttatgctagtgttgccatgtcatttgattttagacatgttataaaccccaacatctaagtacatacatagcgatttccagtcgtctccatttatttgtgtaggttcagatttctgtctggtatccttatccttaggcctggaggactccttcaacatttcttgtagtgtgggtcggtgaatgctttcatttatttgtatgtttttatttttatttgtatttttttaagatggagtctcactctgtcacccaggctggagtacagtggcatgatctgggctcactgcaacctccacctcctgggtaaaagtgattctcatgcctcagcctcctgagtagctgggattacaggcatgtgccacctcacctggctaatttttgtatttttagtagagacgaagttttgccatgttggccaggctggtctccaactccccgacctcaagtgatccgcccgcctcggcttcccaaagtgctgggatacatgtgtgagccactgcgcatgtgtatgtctttaaatgtccttatttcagtcacattttttagagatttttcattgtggcatagaattccaaaataactttttttctctctctcactactttatgttgccactttgatgccttgtcattgatatatcatcttttctgtttttgtaaaactggcataaaggaggcttcctgtacttgttatataatttttggaatgtgtacttaaatttaaaaaaaattgttatactttaagttctgagatacatgcgcagaacgtccaggcttgttacataggtatacatgtgccatggtggtttgctgcacccatcaacccaccatctacattaggtattcctcctaatgctatccctccctttgccccccacccccctataggccccagtgtgtgatgttcccctccatgtgtccatgtgttctcatttttcaacttccacttatgagtgagaacatgcggtgtttggttttctgttcctgtgttagtttgctgagaatgatggtttccagcttcatctatgtccctgtgaaggacatgaactccttcttttttatggctgcagagtattccatgctgtatatgtgccacattttctttatccagtctatcattgatgggcatttgggttggttccacgtctttgctactgtgaatagtgctgcaataaacatacgtgtgcatgtgtctctatagtacaatgatttataatcttttgggtatatacccagtgatgggattgctgggtcaaatggtatttctgattctagatccttgagaaatcgccacagtgtcttgcacaatggttgaactaaactaaaaatatgaaaatgggctggatgaggtggctcacgcctgtaatctgagcactttgagagggggaggcgggatgatcgattgaggcccagagttggagaccagcctggattagatagtaagactctctctctctctctctctctctctctctgtgtatatatatatatgtgtgtgtatatatatatattaaaaatatatatatacacattctctctgtgtatatatattatatatatataatatatacacacactctctctctatagatatatgtatacacacagagagaaatacgtccatcgtgagagtcctagattcatcttaagtttcaccgaaagtgcacttagagtaaaatgtgcccactctgagggtcaaacctacctactgacgtgtaagttgtgtttgtgagacattctcaacagcatttgctttccctagcatagtggttttcatgttttcctcacacctgaatgtcctcagtgcaaaacctgtcagaattcatttcctttgctgttcttctttgagaaacctccagggttttatttatttattacataccttttaaaagcatagagacaaagactggcaagtggtatatattactacattagtcttagttctccagaaaaagaaaacgagcaggatacacacagacacacacacacacacacagagatttacattggctaatgtgattatggaagcagagaagtccaaggtctacactgagtaagctctagacccaggagagtggaatatagttctctaccaagtccaaggcccaaggcagaagactgatgtcccagctcaaagacagtggagcagagacttctttcttagcctttcattctattcaagccttctgtgggttggatgaggcccactcacactggggagggcaatctgctttactcagtttaccgattcaaatgtcaatctcatccagaaacactctcagagacacagtgagaaataatgtttaaccaaatatctgggcaccccatggcccgttcaaactgacagaaaaattcatcttcacaaatactctcaataaaagtgactaacaaatgtagcatcatgtcctgcctgtttatcccatgacaattaatgtattccagcccaacattgtcttcctttctcttacagaagcaacatgtaacagtttcattgaaagtaaggttgcccgggcacagtggctcacccctgtaatcctagcactttcggaggccgaggcgggcagatcacctgagctcaggagtttgagaccagcctggctaacatggtgaaaccccatttctactaaaaatacaaaaaattagtcgggcatggttgtgcatgcctgtaatcccagctactcgggaggctgaggcaggagaatcatgtgaacccgggaggtggagattgcagtgagccaagatcccgccattgcactccagcctgggcaacaagagtgaaactccatttcaaaaaaattaaaaataaaaataaataaatagagtgaggttaattttgaccttatggagtctctccccaacccctacatacctttgcacttgtggattgtcattttgtcatggctttgatataaaaatatatcaataagctatatgcagtgctaatgtaagtttgaatttcatcctgactccataagtcactttccattttgataaagcctagaaatattcatgtccatctccttgaatatgggtaatggatacctattgtggggcccactctcaatctcatggggttttttaattttttttaattttcattcaggtctcaatagatatgcctgggctgactgaaagccactgaaaatggcccgtggccttgtacatctgacagagtggactaaaatctaagccatggaatggggggatggaaagtgagaaacaccaaactcagcacacaatgactcagtttaaatctctgggctaagagatctatcatggcttctgggacataaggctttgtctggagggtgactgtaggctcccatgacaatgcctaccccagaaagctcaaggctgccagaggaacttactttagttccagccaatacctgctgatgatggtaggttcaggatctcccttttgtatagcacttactaagaagggaatccttcctccatccctttgagatgtgtttgtatctcctagggactccagtgtgtctttccctaggatctgaaagccattcctttgagctgtagttctcaggaaggactgagcctctgtcttccagtctctgtgggaggttagaatcctatcttctaatattgtcagctagcagacacagctggcctgatgaggcagacattcacaatgtttcacttgtgccctgccccctgccctctcccctacctccctctccccctataatgccatcacctctgtacaaatgggaacacagctcagccccgttctctactatcagtagttactgaataaaatctgttttctctgctttaactaatgtctggctttatcttcgacaaaataagtggagcgatgatttttagggacaaggcagctgcaaagagaggcacagacatgggaggagagggagggatcacctgacccttttcatttcgtaggtatctattcctgcctggtgtttataagcctgacacttggctgggcttccctggggtatatctccatggctctgtggcaagacttgaataggctggtgatgacacttgatgtccccatagccaccttcaaaaatgtcattaaaggcttgcgagaaaatggaaggaaacacagaaaacctgattttgaaagttgccgcctctccttcttcctcattcagagcgtgtacgatattgctgtgcggtgtttgttggactgcaatttagcacaacaccttttctaatatttggcagtttcttgcagagttaagcctaccctataaggaagcaaatttactttcattcattacccatgaaaaatgaacacatacatccaataaggcttctacaaaaaatgctcatagcaaccttatttttatactaaggaaaaactgggtacaacacagtcttcatcaacagaagaatttaatacctactgttatatagtcataaaatgacctcatgcacagcaaacaaaaacaagcaaaaaaaaaaaagtaggaaaagtatgaaaaaacacagtaacatgggtaaaaccctccaaacactatacttagcaaaagttgcctataaaagtatcctttgaacatctaaaacaaatttatcttaatgtacctgtctgatactcctgtgtaattccatttatatgaagcatcaggactcaacagtggctccctctttgaggtactttgatggaaaacttcctgggttgatggaaatgttctatgtggcttggtctagttgatacttacaagggtctatacatttattaagcttcacggtacactttttacatttacatttttaatataaaaataatgttaattatttttaaactgccaaaatcccaaaatgaatacttgttttagtattggtttaaccctgagatatattttttacttatatacatactgtaaaatctgtataataaagtttggagtaaattagacctttttactcttcctacacaatgctagaagtctggaacatcttaattccatttaccctccttgtgattctcaagttactctcattaattttaaggcaccatatattttaagtcacatggacatcattatgatcattggattagtaaaacgtactatttgactgagccacacattaaacctacacatcgccctgcgttccttcgttccctttccacattccccggggatatttcacattttcgcatttcccttagttagcatgtgctgcttctccagaaaggtctgcacttcaccttcacttgaaagatctgtagtcttgggttaggagccagcagtcagttgaaaatggtagtattttagaactctatgatgtcttactttttcactgctgtgaatttagcacctgacctttggacacaataggaatttccccctctgggggctgctctggttttcccatgtgccttgggcattcagcagtgtcctgatgacatgcctcggtgtggtttgtttgtccttatgctgcttggagttcatagctcttcttgcacatgtgccttgatgcctcgttgggtttgtttctcttaattgtccataggtaagaactatttcttttcagtattgcttctgtcccattttctgtctcctccagcttccaggacattagtgacaatttattttaagcatttatgacataactcatatatatatatatatatatacacacacttgtttcttagttttccttcctgctagctctctctccgcttgtctggaaagtctccgcttacttatcttcaggctagtaatccatcttcacatggatccaaactgccattacaccaatctattgactttttaaaataataactattgcattttatttctaactttaatagattttctttccaattataagtatttattacatctctatgttatttctaccattaccgtattttatttgtataatttccattttatttcaaaataggttattattttctggtgaaaatttttaccgtctcttccattcttctgaacatctaaatcatatcatttgaatgttactgtcttataacctcgatgtctccatcatctgtgaaaaacctactgtttcctgttttgagtttgttttctcttgcctctgcttctttatatgcctagaatactatgactgaatggtgggtctctgtgaaaaattatgaaaggactgagtcgtgttctctgtctctgaagatgaattcccctctgcccctggcaggcaccagaggcacagatcacctcaaccccatctctgtctcggctgacctgcagcttgtttttcctcttgggaaactcagcagcaggatttttccctcagagaaacatcacatttaaagcatacatagaaaaaggtggggtttttttcataaaaagtcttagttttcttattgtaaatttaaacacatggttattactgttcttaagctaattgggctagcctgggcaacacagtgagaccccgtaactatgaaaaataaaaacactaggcaggcatggtggcatgtgcctgcagtcccagctactcaggaggctggggcaggaggagcacttgagtccaggggttcaaggcagcagtgagctagatcatgccactgcactccagcctgggtgaggaatagagaccccgtctctgaaaattaataataatcatatagtaataataagacaattggggcagtacctcctttatattgatcagatactcgatttgtctataccctccagaggaagacaaagtattctactttgtttcctgagaaaatactgtgtatttatatatgaaaaaaatccattaaaatactgggcattctaaagcatctaaatgtcataagtaatatcatttaaagtggaaacagaggcagtggtgtctatcaaggatgcttatcagtgagggaaacaaaaggaatcattaagcacccttggatacctggagggcccctctgccaaaaatctcagtaattctgtgatacacttttgagtctagcaggttattctcttttccagagtacgaagttgccaacctaaaagaacaaccaagagagagtggttctccaaagaagtgaatgtttgggaataaacagaggatttcaatccaggatatgcgcactatcgtatgaggacccaaaggcacaaccaggcaggctgagaaggggaacctttaacagcgaaaatgaggaaggttacatagttgttttgaaacaattatccttggccacaaggaataatcacaagggtggcatcagtccaaggatgaataggcagttgctgggcagatgtcgttgcagagagattctttgggtaaggttgtggtggcctttgtgcaaagttgtggttttcagagagttcttgtaatagtttttatcacaggcatgtgtgtgtgagcacccctcctttatgatctcctgattgaattttgttaggatttggcatacgtgactccatttttcattctgacaacttttacaggtcattgcttttcatccatttttactaagggctggacttgcttaaattccaggaaattatgaggtcttgatttgtataattatcacaagtgctcatgttgctgactcagttgcctatttgggatgttataattgtcttttttctccttcctgtgctgtaatttacacaatccttagaggagattaatttgatacttttcagctgtgaaaaacttgaatatgccaatcaaagaaaggttcccctcacatgctaggaatttagtttctttcctgtgctaagatccatttaggtatagcactttcctggagccaagagttcttatgaaatggggtgtggcatattgtgtattaagatcatccttattacagagatgccattcttgcagatattgacagctaatgtgtccctaagacttttaccaaacatcagatagacaagatatgaaaaccttctcattgctgcagtctcaaatgtcaggaaagaccagaatctttaggataatggacaatcaagaaagactcacagactagattagctgtcatgtactgccaatcagggaatggatccttgtcaaccaccacctaacagagattgtccccagaagttcactccataacatcaaaaccagaaacccacattggtgccactgatgacagaaaataataatgcaaaaatgagaaagaaacagtgagagagagagagagagagagagagaagacatagagggagacagagacatgtactacagccatacttagtgattaaaagccaaagagctcaatttctattcatgatattcattaaaagaagcaaggaaacaggagctaatagctctgagggttcaggtctacacaagatgcctgttgggtggagggttctgttggctccagtgatgtttctcagatgtgctaattgttatggacatagcccctgaaaaaacctatcaaataataatacagggacagctatctgcatgctaatttaccattgtataggagggagaaagggcattagattggttttggcaaataaaagaaaaaccaagatttatgaagaaaagaggaaaggggagaagaaaaaaattgcctgggacctttgtgattttgctccccttgtgtaagggacttgacagaaagctttccaagaggtcgctgtggcccatcttctctggaccagtgtgacttggtcatcacagaaaacaatcacggatgttggaggactttaaaatatcttagaagtttagcagttcatcctatgtcacagagtttctgtgtgcgatgtccaccatgtcctgttgtacaacccctcagttaagccaggagggtgcctctcccctcacgaccagcctgggcaacacggcgaaatcccgtctctacaaaaaatacaaaaattagcccatcgtgtggcgcacgcctgtagtcccagctccttggggtgctgaggcaagaaaatcgctcggccccaggaggtcgaggctgcagtgagccatgtttgcactactgcatgccaacctgggtgaccaaggctggaatatcatacatccatgtgtagaaagtttgttgtgccggcaagtaaatgacaaaggggacattaacagaactgagaaacaaattggaatacgatttggtaccgctcccacgaaagataaatttgcagaatgtactcaaattggaaacattaaataaattctataatgtaaaattagcacatcctgttgtccacactatagaaatatctgcacaagtgaccgaagatatgtgtacaagaatgatggtgattgcagcatcatttgtaatcctaaaactatgaaacgcacctcacttcaaaaacattttgaaaagggttaaataaatcatgcacaaactcaagaagaaatgctgttctcacaaacactggcgatgatcaccatgaggatgactgattccactggtcacattattgatagagcaatcagtaaacccaggcacatcctggggataggatactactgtaataggcctcctattattaaacatgaaaaacttgaagcacaaaatgtccacctaactgacccaagtcatgggagcaaggaagatttttatcacaccacaggtgagatcctttctaaggtctatgggattcctgagtttgataggtataacgcgcggtggcccttgccaagcctcagacttaaggtggataggaagtggggacatgtgtgtctggtgatcaatcaggagttggttgtcccatcaacagaaacaggttaaaataaagccccagggccccggctggaactaccaacctttctattaacagcagaatgctctaacgaattgcgctgcaggtacacgttccgtgccttcttctgggtgctataggaagggtgcactcagcaaactccccatcccctcaatcttcaggggccctcctggcaggacgactgtgcaagttccaggtccttggaaaaccggagagattagagcggtgaattgtagtgttggacacctgcgcgttgggatattctagagcacgaaggacagccgaatggccttcgcccgccctgcccctcgcctgcttcagaagcccgaggaaacgcccccgtcagcgacccgagccgccgcctcgaggctcaggggaagctgaacgcccggtgggctcctgggatgcatcttcgcgttctttgcgccgccttcacccactgagggagcctgtgcccaccctgcccagtcgctttcggggccgctgcggagcttccgctgccatcttcggatcctgtgtcccgcacgggggctccaccagggcagggatgatggtgagggtcgctcgtgggtcccctcgcgggaaacagggtatggcactcaccagagcgcacgactaggacttgaattaatccatcgtcgcattcagtttttagtcttttgaagagctctgaaaatagaaatcatgaactgtttttccatggggaagttttgttttgttctgtttgtgagacagggtctcacttggtagcccaggctggagtgcagtgatgcaaacacggctcactgcagcctcgacctcctggggccgagcgattttcttgcctcagcgccccaaggagctgggactacaggcgtgcgccacacgatgggctaatttttgtattttttgtagagacgggatttcaccgtgttgcccaggctggtcgcgaagggaaagtaagtttttttttttttttttttttgatacagggtctcgctctgtcgcccaggctggagtgcagtggcgcgaactcggcccactgcaagctccgcctccggggttcacgccatttcctggctcagcctccccagtagctgggactacaggcgcccgccacaactcccggctaatttttttttttctttctttctttctttctttctttctttctttctttctttctttctttctttctttctttctttcctttctttctttctttctttctttctttttagtagatacggggtttcaccgtgttggccaggatggtctcgatctcctgacctcgtgatccgcctgcctcggcctcccaaagtgctgggattacaggcgtgagccaccgcgcccggcggtaaattctttttaaaaagcgtttattccgatggatttcctggcatcccgtggggcggacaacgggctgaggcctccagtaaaccttctgcgcgatggagctgcgggggctcagctgcgctgtttttgggtgggtgcctggggcactagggcgggagcggggcactgggtgggtccaacgggtaactgcaaggaggagagcaaggaagtcggcagaggcggcgaccctggcgaggaaacttcccagtagctttgttcagcggtaaggaccggatccctgagagacaaaaatcatcttttctactgtagcagagtggggagaacgccaggaaaaatggagagacaccaagaaagaaggaaaatcatggggacccttaggccgaagcagccctatattaagtttaaagaagaaagcaggcggcttcctgtgatggtatattggttagtactctgcatcgccgccaagggtggaatcccagtcatggcagtgtccctcctggggcgtggcactcctcctttcctttagactccaacctctgcctaggctgcgctctttacctgcgactagagaggttacaacttaccagtgccttcggagctctgtgcagtggtgagaatagaaggaacccctaccttgcatgctggggtccagtcatcttgaaaggctgggcttttgccccctctctgagcaagtgcagcacccaaaaggtgaggtgctccctctcagtcagccttattggaatcctccactattaccacgatgtggccataaccgtttttctggttcagatatttcaatcatccgtggggccttttaaggccgaatcagaaacaagcgagaggacatgaggatagtttgcactccaactgggaattttaagtaaagcctaaagaatacaataaaatctaaacttaatgtcattccccaacacccaattgttatttgtttttatttatttatttgtttatgtatttttgctatcagtaaatgactgaagtataatccacacagaccaaagtgttccaatctgaagtgcacagcccagtgcattttgacgtaagaaaccatcacccagatcaagttatgggacattttcaccagcccaaaaagtcatcagagcccctttccagtcagtcctcaccccatccccacttaggcaatcaccattctgatttctatctccatgggttacttttgcttcttcttgaaattcacgtaaaggaatatactgattctgtttcttttttgaatgcaacaatggttttgagatacattcattttatggcatgtatctcaactttttgatgttattgatgaatacaataccattgatggaagattggaatatttctacttttggctattgtgaataaggtgtttatgggcctttttatggacctgtgccttcatttctcttgagtataaacctggcaatggaatggccaggtcatggagcaggcatatttttaactttattagaaactatcagacactcttttagaatggttgcaccatcatattctcttgccagcaacaagggatacatttgctccgcactcttataagctagtggttttccctgtctcttaaatgttgcccgttctgatgggcgggtaatggtgtatcacggcattttaaatttgtgttttctgaatgagtgacgatgctgataattctttcttttgacatttggacatgaagaaatcctcttttgtgaacaaacactgttcaagtgttttgttcattttaaattggcttgactctttcccctcacccatttttacataaactttactgttagaatagaaaaattgagaagctagtacacagaatggagtaaagaggctggaatgggtttggggaaccaactcacattttatggttaacacattgttcaagaacaatgtatgttttccaaagacatccccttattgaaatacgcagagaaagtgtgggataaaagagcgtatactaaacatctcagaacgagtttctggaagtggacaagggaatgggaatgcgataaacagagaaaaggagagacagttaagggccttgctcagagcagccaccataatgtgccctgtgctaaggacatggaattttgaaaacagaaagttcacccagacagaccagtctagataagaaaggcaggaagagactttaaaaaacaaagcaaaaacagagaaatcatacagtgagatgctgggaatgagactatgcccatcacctccaacataacactaattactgctaattgtaatgaatctaaatctctcagattggatagaaaaggaaatgctggctctaacagtttaatggacagaaaagggttaaatattaaaagcagtgcttattatccttagcaaactaatgcaggatcagaaaaccaaataccacatgttctcacttataagcgggagctgaatgatgagaacatgtggacagataggatgggggtggggacagcacacactggagcctgccagaaggtggggctgggaagagggagagcatcagaaagaggagctaatggaaggtgggcttagtacctgggtgatgggatgatccgtgcagcaaaccaccatgacacacatttacctatggaacaaacctgcacatcctgcacatgtacccctaaatttaaagtaaaactggaagtaaaacatttaaaaagaaaagaaaacaaacaacaacaataacaacaaaaagagtggtgcaaatctgtaccaggcttattggaaacaaaagaatgagagtgaaaacatgggtatcagacaaaggcaaacagcaaaacaatgctttatattagctaaaggagtaatatcctagcatctaactaaagttgaatggaatcgaatggaactgtttttccctgaactggcctccttgggtggccaaccagggcatggtgaagggaaaaaaatcttggagtgcaatgtccatttctttgctcttgttttggtctctgtaaggcataagaagttaaaaagcaagatctgatcttcggagttttccaggaattcgaaataggtatatgaggaaagaagctcaattatcacccaggtctccgggagtatcccaggtatagtgccaagagtccagctttccgaaccggggtccctgggttctgaaggcctttttggggaaagtactgatgtttttgtcaaggttgggaggaaagggtttggaaggccccaacacccaccactggtcacacacatactggctgaattccagactatgctggctggtctcaaactcccaacctcaggtgatctgcccgcttcagcctcccaaagtgctgagattataggtgtgagccactgcacccagacccagctaattttttttttttttttttttttttttggagacaagactttcactcttgttgcccaggctggagtgcagtagtgcgatcttggctcactgcaatctccaccttccaggttcaagcaattcttctgcgtcagcctcccgagtagctgggattacaggcatgcgccaccatacctggctaattttgtatttttagtacagacggggtttcaccatgttgatcaggttggtcttgaactcctgacctcgagtgatctgcctgcctcggcctcccaaagtgctgggattacaggcatgagccactgcacccagcctgttttcaaggtttttatgaacactggtacctccatcattttcaacaggtacaaaaagcagaaagtggcaagaagaaaaagcctacagttaagtttccttcattcaacaaatactaattgagtatctactatgtaccaaggcactgtcctaacacttatgaaaaagaaaacatcaataataagagtggtgaggaaataagaaatttaaagacatataggaattgtctaaaggccaagtaaatctttgtcttttagactaaaaggctgtgctaaagtagtgaataataagcaagaaaaaaaaaagaagagtgaatgataaaacagaaaaatgttttcctgtatgactagaggtcattcttaatgaggacaatacaatcatctaggggatagttgggacatctatggaagtgctttggttgtcacagcagttaagaagtgcttctcactattcacaatagcaaagacatggaataaacccaaatgcccatcagtgagagactagataaagaaaatgtggtacatatacaccatggaataccattcagccataaaaaggacgagtgattactttgcagggatgtggatggagctggaagccgttatcctcagcaaactaacataggaacagaaaaccacacatcacacgttctcatttgtaagtaggggctaaatgaggaggacacatggtggggaacaacacacactggggcctgttgagggagcctcaggaagaatatctaatggatgctgggcttaatagctaggtgatgagttgatctgtgcagccaaccaccatggcacaggtttgcctacataacaaaacctgcacatcctgcacatgtgccccgggacttaaaataaaagttgcagaaaaaaaaaaaagtgttactgacattcagttggcagaggccaggaaagcataggcaagtccagcacaaagaaaaaatgtctttattctcaaacttccttatgaatagttaactggattttaaaaatctgtataattaccaaagcctagaacctaattacattctacgtataagcaccaagtccttctgcataattttatttatttatttatttatttttgagacagggtctcactctgtcacccaggctggagtgcagcggtgtgatcacggttcactacagccttgacctcttgggctcaggtaatcctcccacctcagcctcccaggtagctgggacttcaggcacgtgccaccaagcccggctaatttttaaaaaaattttttgtagagacagggttttaccatgttgcccaggctggtctccaactcctgggctcaagtgatccaaccgccttggtatcccaaagtgctgggattacaggcgtaagccaccgtgcccagtccataattttaatatgtactaaatgtccagaaaagcaactgctgaataaagtaagagaaaactgtactttggggcagatgcagtggctcacgtttgtaatctcagcactttgggaggccaaggaggaggacagcttgagccaaattcaaaaccagcctgggcaactaagtgagaccccatcactaccaaaaaaaaaaaaaaaaaaagaagaagaaagaagttgtacttgagttttatttgtacatttgcaaagaattgttcactgtactggtttgcttctcctggtatttaagttgcaaataccctcatagcagtctactcaggtagctgtcatgtcaagctaatctgtcagaaatattttctatttatcctttatcttactgcaagataatttttttaattatatatgtagggccgggtgtggtggctcacacccataaccccagcactttgggaggccgaggcgggcgcacttgaggccaggagttcgagaccagcctggccaacatggtgaaaccctgtctctacaaagaataaataataatacaaaaaaattagccaggtgtggtgatgcacgcttgcaatctcagctacttggaaggctgaggcacgagcatcgcttgaagcacccaggaggcagaggatacagtgagccaagatcacgccactgcactgcagcctggttgacagagattctgtctcacaaaaaaaaaaaaaaaaaaaaaaaaaaatatatatatatatatatatatatatatatacacacacacacacacacatatatgtagaaaagctgtattacctgtggatttcatttcactaaagagagtatttcaaaatacttataagaagagggcactgaatctgagaggtctgagaattaacgggctagaagatcagcatcactgtaggatacctgcaggtctcagttaatccagcaaaaggtaagaaagagcatgtaactataactgttttttcttttgagaatgtaaattctaagcatggtgaaaggtaagcaaaatgaaacttctggaagatggtactatgggttaaaagtctattcaaatctgtacaacatcaaagtgagtggcaaggaggtaaacattaccttgtctactaagaagtttcctgtgacacttgttcaaattatcaaggagagagattaatctgtcctaacagattttcaaggaagacaaaactaactggtctggccaggcgtggtggctaacacctgtaatcccagcactttggaaggccgaggcaggcgcatcacttgcaaggtcaggagtttgagaccagcctggccaacatggtgaaactatgtttctactaaaaatacaaaaattagccaggtgtggtggcgcacacccataatctcagttactcgggaggctgaggcacaagaattgcttgaacatgggaggcggaggttgcagtgagccaagattgcaccactgcactccagcctgggcgacagagtgaggcttcaggtctcagaaaaaaacaaaaaacaaaatctaactggtctgttttgggaaaagagtcaccaacagtctacttatcatacaagaaaagtatgcctggtttaaaaatcactggtgccaactcacttctttttttaatttttttttaagagatggggtttcgccatatcacccaggctggtctcaaactcctgagctcaagttacccacccacctcagcctcccaaagtgctgggattacaggtgttagccaccatacctgtcctacttctaactgatatacatgcatctggggacctctgagaaactctgaacagcaaacaattgaaaaaagaaatttctaaaaaagaataatttttcagcacctaaacttctgtatgtgaaactataacaacaacctaaaatgcttctaatacggtaatggccctatttctctgcaaataaggattgctcatgattcttacactgcctttcaattaggattatacagctccattcctcattcaagcttccaatacgtgcacctaagtatcattttacaatgggatatacttaggtaaactgagacggtcagatgactcagcgagaagtcacccgaagaattttagaacaaagattaataactccaatataccctctcaaccaagaatttgaagaaactaaaaggttaaacacaaaatttctggagcttatgaaacttctgagaggtataagagaaacacagaaagtaaaactaaaagttaggcttgttgtctgcttttcattttgttttcaaactgggatttccagctgtcttactaaattacatgcagtgtttctatctcaattaattcccaactgacaaaaaaatgtggatagttttcttttataagttgcccttacagtatgtaacttgcgaggggtaatccaattcctctggtctcagtaattccaaagacagaaagtaactccaatagatactgctataatggaattgcagccactaactgagccctagttcctgttctaaaccctctctcccatcagaggtttgcctaaaattatacggtctcaattttcttactgaaaattcactgggatcccaaaattaaaaatcaaacctacaccaaaacaaaaccttaaacacaattagcacaagatgacactgactatccctctatctatcccagggtttctcaacctcagccctcttacctttttgggcccaatataattctttgttttgaggggtctatcctgtgcactgcagcatgttcagcagcatctctggcctccacccactgcatgacagtagcaaccctcctctagcccctagttacaaaaatcaaaaatgtctacaggctgggtgtggtggctcacacctaccatcccagtactttgggaggccgaagcaggactgcttgaggccaggagtttgacaccagcctaggcaacacagtgagactctgtctctaaaaaaaattaaaaaattagccgggtgtggtggtacagctagttgggaggctgaggtgggaggattgcttgagcccaggaggtggaagccgcagtgagccgtgatcacgccactgcactccaacctgggcaacaaagtcagactctgtctccaaaaaaaagataaaaaattgtctacagactttgccaaatgttccctgggaaacaaaactacctgaaattgaaaaccactgctctaggctatctcatttattgctcagcaggctgtgaagagatccaacctggccaacatggtgaaaccctcgtctctactaaaaatacaaaaattagccaggcatggtggcaggcgcctgtaatcccagctacttgggaggctgaggcaggagaatcacttgaaactgtaaggcagaggatgcagtgagccaagatcgtgctactgcactccagcctgggtgaaagagggaaactctgttaaaaaaaaaaaaaaaaaaaaaagaggcaactaaacataaagaaatacaaagtgttagcacatctagttggtacttcccccgaaaatacaaaaaaatttcttctgcagtgagttcaattttcagatttttttcttccttatactgaaaaagtcccacaaatttccccaatatatacatttatatttatcagtagaattacaaggataaactagcctctacctataagaatacatatttatttctagatattgcagtgaatatacgtacttcactgtacgttcaaatttcacatggtagcacctacattttgtaccactgtagccttttaaagatgtcaaaacactgaagtcatcactttttaaatataattactgggtgttcaattcatatcaatcattcaattaaaaaatatttaattagcaactgctatatagcaccagatagacatctctctgggacctttctaagaatcatgcaacttagaaaggtcagttgagcttaaacggtcacaaagtctttaagaaatctgctttttagctacttttattatgggtggtttgaacattttcctgtattagagttattgcaagtacaatacaatgatgaatgccttctctagcacctggtagagccaaactagataacattacttattgataaggaaaacattttattagatcaaagaagatgataaaataagtagagggagagaagcctactacatagtttcttcaggtggagcctgaaagcgagcagtccttaacctgatctcttcatctggatttaggaagataccctgatctccataaaatacttaagaaccaccctagtctcatcaataccaaaagtaggttactctgcatatgatttatctcacctgtttaatgatgactctaccagatttaatcacataaggtaacattccctgaccttgatttaatggggaaagacggatggtagggtgtaggaatggaataacacctttacactccatgacacagccctctgtggtgtactacccagtcattcatcatcaatgtggcatactaactccattagtcttggcttcacattgtctctcaataagataggtaaggtaggagtttctgctatggttttgaaaataataatctgaagttactttaagtatttattctataatctgatgaccaaaaaatctacaatggcattttacccaatcctacagaaacttaaaatcctgaggctccagactatataatcgaaatctctgattttaaaatccaagtttagtactcacaaaattttactaaagttattttcactgtaaataggaaaacacttttaataaggagaaagaaattcctaaaccaatactcacttggaatggagacttttttgaaacctaacagaaaacaatgccactaaatatgttttcattttaaaattcccttcatgatttctccttatttcttaatgtcctctttccaaatgaaccttttgtcctctttttgaatggtttttttttttttttgagatggagtctcgctctttttgcgagtgcaatggcacgatctcagctcactgcaagctccgcctcctgggttttcaagcgattctcctgcctcagcctcccgagcccagctcaaatcactaaattgcttagattagaggcgcccaccaccacgccaggctaatttttgtatttttagtagagacaggggtttcaccatgttggccaggctggttttgaagtcctgacctcaggtgatccgcccaccttggcctcccaaagtgctaggattacaggcactagtcaccatgcccggccctcttttgtcctcttatctgagtggatccaacccaaagacacacaaagctaaaattgatcaggattagcagtaaggagtgttattctgtcaaattaaatgaattcagcctacatgtggctttaaaaaaaaaggtgaaataataaagtaattaaattttaaaaagaagagaagagttattaaaccttgcaacctagtcccgttgaacacaattatggctctgaagcagaccttcccattgaatgggtgaagaaacctagtgagagctcattaaaagctgatgtaaactcaatacccagcctctggtgttcagtgaggacagcactcatagatgatgggttctttctttctttttcttttcttttcttttttctctcctctctcccctctctcttctctctcatccagactgggtctctgttgcccaggctggagtacagtggcacaaccatagctcactgtaacctcaaatatcctgggctcaagtaattcttccacctcagcctcccaagtagctaggactacaagcacatgccaccatacccagctaatttttattttttttgttgagacagggtcttgctatgttatccaggctgggagaacattttaaacaaagggagacagaggtctaaaaatagataatgcataggagaatggtgaggtaaatgctatggccaaggcacagggcgtgtggaggaatgagttgggtttttgaagttgattagattaaatcatggagtctttttcttttttgagataagctcttgctctgtcacccagactggagtgtaatggcacaatcacagctcactgcagcctcgacctcccgggcttgagcaatcttccccgactcagcctcctgagtagctaggaccacagacacacaccaccacccctggctaatttttttaatttttctagagatagggtctcactttgttgcccaggctagtgccaaactcctgggctcaagcaatcctctcctgccttgggttcccaaagtgttggtataacaggtgtgagccacagcatgccccagtgagggatggttcttggtatccaactatcacaagagtcagtaccctctttgtttactttgtttttataaaatttatccatatctgattttgactggggtattaagcctttttatatattgactataaatggtttttaggttttaggtccttcattttgctctttgttttctatacatattttttttgattttaggtttggggacacatatgtacatttgttacatggacaaactgtgtcactggaatttggtgtactgattatttcgtcacccagcaactgaccatagtacaagataggcagttttttgaccctcatcctcctcttaccctcaccacctcaagtaagccctcgtgtccatgtttatgcccatgtgtactcaatgtttagctcccacttttaagtgagaacacgtggtacttggctttctgttcctgctttaattcacttaggataatgacctccagctgcatccatgttgctgcaaaggacatgatttcggttttgttttttttaaatagctgtatagtatcccatgatgtatatgtaccacattttctttatgaagtccaccactgatgggcatctaggttgattccatgtctttgctcttgtgaatagtgccacaataaacatacaagtgcatgtgtctttttggtaaaatgatttatattcctctgggtatatacccagtaatggattgctgggcagaatggtagttccgttttaagttctctgggaaatcaaactgccttccacagtggctgaactaatttacattctcaccggcagtgtataggcattcccttttctccacaaccttgccaacaactgttattctttgactttctaataatagctattctgactggtgtgagatggtatctcgctgtggttttggtttgcatttctctgacgattagtaatcctgagcattttttcatatgcttattgggctgcatatatgtcttcttttgagaagcgcgtaggcaaaaaaaccaaaatcataccaaccacactctcggattatagtgcaattaaaatagaaatcaatactaaaaaggtctctcaaaactatacaattacatggaaatgagacaacttgttcctgaatgacttttcagtaaaaaatgaaattaagggagaaatcagaaagttctttgaaactaatgaaaacaaagatacagcataccagaatcactaggatacagttaaagcagtattaagaggaaagtttatagcactaaacacttccatcaaaaagctagaaagatctcaaattaacaacctaacatcacacctagagaaactagaaaaacaagaacaaaccaaccccaaagccagcagaagaaataaccaaaatcagtgctgaactgaatgaaattgagatgcgaaaatccatacaaataaatgataaacgaaaccaaaagttggttctttcaaaaaataaaattgatagaccactagctagattaataaagaaaaaaagagagacgatctaaataaacaccatcagaaatgacaaaactgacattaccaccaatcccacagaaatacaaagaactctcagagactattacaaacacctttatgcacacaaactagaaaacctaaaattccagataaattcctggaaacatacaacctcacaagactgaaccaggaagaaactgaaattctgaacagaccaatgacgagttccaaaattgaatcagtaataaaaaacctggccagggccatggctcatgcctacaatcccagcactttgggaggcaaaggcaggcggatcgcttgagcctaggagttcaagaccagcctgggcaacatgacgaaaccttatctctcaaaaaaaaaaaaagaaaaaaaaacagccaggtgtggtagcacatacccgtaggtccagctactcaggaggctaaggtgggaggatcacctgagtctgggaagtcgaggctgcagtgagccgtgatcatgccactgaactccagtatgggcgatacagtgagaccctgtctcaaaaaataatgaaaaataaaaaacttaccaatcagaaaaggccctggaccagatggactcacagccaaaccccaccagacacgaagaagagctagtaccaatcctactgaaattattccaaaaaatcgaagagggactcttccctaacccattccatgaggccagcagcattctgataccaaaacctggcaaagacacaatgaaaaaagaaaaccccgggccaatatccctaatgaacacagacacaaagattctaaataaaatactaacaaactgaaccagcagcacattaaaaagctaatgcaggccagtgtggtggctcacacctgtaatctcagcactttggggggccaaggcaggcagatcacttgaggtcaggatttcaaagccaacccggccaacacggggaaaccccatctctaccaaaaatacaaaaattagccaggtctagtggtgcaaacctgtaatcccaggtatctgggaggctgaggcacgagaatcgcttgaacccaggaggcagaggttgcagtgagctgagcttgttccactgcactccagcctgggctaaagagcaagactccgtctcaaaaaaataaataaataaaaattaaaagctaatctaccacaatcaagtagtctttactcctgggatgcaaggttagttcaacataggcaaatcaataaatgtgattcatcacataaacagaattaaaaacaaataccacatatcaggccagccgcaatagctcatgcctgtaaccccagcactttgggaggctgaggcaggcagattgcttaagcccagaaatttgagaccagccggggcaacatggcaaaatcccatctctacaaaaaagaaaaaaaaaattagccaggcatggtggaacgcacctatctactactactcaggaggatatagtgggaggacacattgagcccacaaattcaagaacagcctgggcaacaagacagaataaattctgtctctatttaaaaagaaaaaaagaggccgggtgtggtggctcacacctgtaatcccaccactttgggaggccaaggtgggcatatcacaaggtcgagatggagaccatcctggccaacatggtgaaaccccgtctctactaaaaatacaaaaattagctgggcatggtggcacgtgcctgtagtccccactacttgggaggccgaggcacgaggattgcttgaacccaggaggtggaggttgtagtgaaccgagatcgcaccactgcactccagcctggtgacagagcgagactcagtctcaaaaaaaaataaaagggaatatactgtatatttgaaaattgctaagacagattttaagtgttctcaccacgcaaaaataagtatgtgaggtaatgcatgttaaatagcttgatttaaccattcagtgtatacatatatcaaatcatgctgaacactataaaaaatatagtatacaacttttagttgtgaaaaaaacatgatttattaaatatttctcccttcttcatcaactccctcttccttttgctacctcacagtctttggaattctcaatctgaaatgtacccatccctcaaaactcaatttaaatcccactggccacaccaatgctatgaaattcccctctctgaatcctaaagcacatatcctcattccctttatgctgttactttttctatgtttgccttgtctttccccaaaagctgtaagatccttaagggcaggagccacatatcactccctatcacctccaggacactcagcagagaaccttagatatatttaggaagaatccggttatactcaattgtgttaggcctcaatttacaaatcagacatgacaaataatatatcacaccaaaaagatcaagaaacttctccaggcattaactaaggcttagaaaaacacctattcagcctttcaaattatccctttgaagtaaggacttaaaggtgagaagaaaagatataatcaattggggaagtttagactgtcttctcactctttttttttttttttttttttgagacagggtctggctctattgcccaggctggagtgcaatggtgcgatctcagctcactgcaacctctgcttcctggggtcaggcaatcctcctacctcagcctcctgaatagctgggactacaggtgcatgccaccacacacacggcaaatttttttattttttggtagagacggggtttctccatgttgctcaggctagtctcgaactcctgagctcaagcgatctgcctgccttggactcccaaagtattgggattacaggcctgagccaccacgcctggccaacttctcactcttaaaggcaaaatagtgaacaacaacttaaagatcaaaaaagctaaggatagaatattcaacaaggcatcacattcaacaacacaccactggtcacacacatactggctgaattccagactccctctctatggtaaaagagttctgcaggctctgatgttggctggaaaaaaactagacacctgctcttcccagcactgaaatatggccaaaaaaaaaaaaaacataaacacacagcaaaatcagcaaacaaaactaagtagcatttaggcggggagcagtggctcacgcctgtaatcccagcactctgggagcccgagtcgggtggatcacttgaggtcaagagttcgagaccagcctggccaacatggtgaaactgcatctctactaaaaacacaaaaattagccagggtgcggtggtcgtgcacctatagtcccagctacccggaggccgaggcaggagactctcttgaacccggcaggtggaggttgcagtcagctgaaatcatgctcctgggtgatagacagaggctgtctcaaaaaaaaaaaagaaaagaaaaaagaaaaacagctaagtagcatttagatgaaactatgactctgaagtagggggtgcggcaagtagagaggaaagaatgtatcataatgccttaaacaaaacttttgagtgagagaagactataaaacaccctttaagcacttattcactggactccatttgtgtttctaagaaataagatatacagactcacttcagaaggttttctcctacactgtatctgagacaccataaatagaaacatacattatgttgccactctatcacaagactgaacctggacacttgtaaggaaaggaacaaccgtaaagacagttggccaaggacaggattgacattcaccctgggggagctcctcgtagtagctacaacccaacccaaaacagcttctgggtttgtgatgctggtgctggctagtatgctgcataaatgttgtttgtttttgtagagaggggtctcactctgttgcccaggctggtctcaaactcctggcctcaagcaatcctcctgcctcgtcctcccaaagcactgggattacagacctaagccaccgcgcctgacctacaaaagtgttttcttcccaaccacagcactgcctctcaaggggctaacactctggcagaaactcgtgaaaaccaatttcacgtcagaggaagcatccccaacattctgtcccggctctttttcttaggtgaagaaagggacagggcggggggcggaacaatgatattaaagacactggcagcatggcaaccaaaataaacgaagttgaaacagtacgtcctgccttcttcctaaagccatttccttcaacagtgataggagtgcagaccgtctgcaagtcattagtacgctgctgtcttcactttcacaaggaccctggaaaccactgaagagcaaaatcccccttttcgccccacagataccttccaaccccctttctgtgcttccttccctagaaaaaaccgaagagtgacaatcctcagcaatccgctatttcgcttcactgacaagggaggtggcgggggcggtggggggtgaaaagtggaaaagaacacagaggaaggtgagaagacacagtggaagaagtgtggggggaggtcatcgtaggaaaaagaccaggtataaaagaatgcaagaaaattgaggggagagttatcagagggaaacttgctaagaaaaaaaaaaaattaaggacacgggaggtaaagaggtgaggtcaggtggagcagcccaggatgaattaagaggtgggcaggaggtacggggccgaggccgtgatgcccagggtttagggccggcggcttagaagtgggcagcaggtattcggcagaccgatgtccggggagtcaatgatgtgcagaaagccccagacccagttccgggaaatcggggccaggaatctatgaggttcccaagtatagagaacacagcgctcttaccggtagtttggggctgacctcgcccttgcaaaagtggcagaaaaaccggtgggcggcgccgtggagcagggggcggtgctcatcggggaggcccgggccgcacaggagcccatggagggggcgggaggctcaggcatggcgggctgcaggtcccgagccccgccccgcgggaaggcaactaaggccccgcgagaaatcgagcacagcgccggtgagctggcactgctgggggacccagtacaccctcctcagccgctggcccgggtgctaagcccctcattgccctcactgctccgagtgcggggcccgccaagcccacgcccaccctgaactccggctggtctgcaagcgccgggcgcagcccgggttcccgctcgcgcctctccctccacacctccttgcaagctgagggagccggctccggccttggccagcccagaaaggggctcccacagtgcagcggtgggctgaagggctcctcaagtgccgccaaagtgggagcccaggcagaggaggcgccgagagcgagcgagggctgtgaggactgccagaacgctgtcacctctcaaaatgacgtagagtttgcagataacctactcacatcctcccgtatgctatgtaaatagttgttatgtggtattgtttagggaataatgacaaagaaaaaagtccatatatgtacagtgcaaacacaataataagttttcaaaaaatattttggagtcaggcctggttgaatccatggatgcagaacctacagatatggaggatcaaatgtaataaatctctctctcttactatatatatgtgtgtgtgtatagtgtgtgtgtatttatatatactgtgtgtgtgtgtatatgtatgtatatgactattgatacagtggtaaggagtaggggagggaagtgttccataatcctatgattaggtctcagtcttgtggtgggcctgtgcccctgggctgtgaccttcaaaagtgcttctcaaattttgttccctcttaggtgagacaggatggctagaggtcactggagttgggtatttccctttccctacattggttagactctggaaacagaattttcttttgagggcacgtgtttgttaagtagaacagaatgcaccgggcatatttttcaacagttacctctccttcccctccagaagcactcaaggagttttctctgattctcaccctaagtcttctggagacaaaactcatgaaggtatgggaggctcccactagttaggcccccaggagtttttacctctcaggctaggctgctgtcagctccagcaattagccaactccctttgaagtatgtctacccaatgctggctccagtggtggtttctgatccaggtaagttgtgattctctgtatttgcccatggctccaggtttcatagggttggcatgtcttaggacctccattttctgttgcatataagtagttattgatgttcggtttgttcagcttttttctggtgagagtgggagtgatggcttttaagtgctttacaagtctggttgtcatttctgataatcatgtgacaattttgatctctttaaaaaggtaatatgtttaattcaggaattgcgaaaagccttgcagcagctacaagaattgcagaataagagccaacagcttcgtgcctgggaggctgaaaaatacaatgagattcgaacccaggaacaaaacgtccagcacctaaaccatagtctgagtcacaaggagcagttgcttcaggtgagtttacatgatttcaatgaacactgggctcatagaactctgaaatttgtttatataattttaagatattaatccacctgtgctgagtccctgctatatggaaaacattgagaggtgggaatcaggaggatttaaaataaatagaaaatataatttgtgaattaagatgcttactaacaagtgtaagaaacagtacatatagccctgatttatgcagtcttttatgaagtcttttataaagacttaatattcagaaaatagttattaagcacctctgtgagtcaaacacttttctgggtgttgggaagacaaaagatttggctactgatctcagtgtaatagatgaagacaaactgtacagaaacttccaaagagtaattttgatgatagaatgaaagtttgaggggaagatggagcattaagaagagactgatctgttctgccacctactctaagcttcagtcacattgaatccactacatttcactgaatgtacaattttttcattgtatgcatagtgtgcatatttttttttctctaacatgtcctcctctccattcttcacttaggaaatcctagtcctttaattaagactcactgcaaatattacctcctctgtgaggtctttactgacacctgcaggcagagttaggcagtgcatcctgtgttcccctggtggctagcgtatgttgcacaacagttaattctatgtgttgtgtctggtgtatgttgcagaatactttacaatttatgtctgttatctctgctaaacttgttacttttgaggagagtgatcacatcttgtttttttatcctgaataactaacaaattacttggcaatttagttaatattggataaaagaataaaagaaacgatgttttggtctcaggaatttcgggagctcctacagtatcgagataactcagacaaaacccttgaagcaaatgaaacgttgcttgagaaacttcgccagcgaatacatgataaagctgttgctctggaggtatgtatcatcatttcgcccactatgctatggattattctatctacataggtattatagaaatttgtgtttacttaaatttgctggttttggatttggttttctattctgccatcgtgttaaataacagcgatcaggacagattattgaacagatggtatgtgagcacttggaaagtggtgagcattagaaaccagaatttctctaagagcaaggtaggacagattaaataagtggaatgaagggttttgcaaagacagagatgtaccattctccaggctgcgggggatgttgagccagcatgctcttcccaccaacatagggccttccttccctgctccttagctctgtttgtcagggcggatgtgcttggggtcatcttcctgctgagctctggccccatgaaaataaatcaatcctcctgtgttcctctcaccagagcactcccaggagatggaaagcctgagggaggctctgctgtcctctcgatcccaccttcaagagctggaagaggagctggagcaccagaaggtggaaaggcagcagcttttggaagacttgagggagaagcagcaagaggtcttgcatttcagggaggaacgcctttccctccaggaaaacgactccaggtaagaggggacccattgacagagaaggtagcattcttcattcttacattcattcttacattataagaagggatattggcaagataattggtgtcctcttttggaaacctcaatgttccctctgccattcctgatttttgtgtgtcagtggggtggggggaggggcgctttgagcagaagaaaggacttctctgggaatgccttgtcactcccaagttgagagagtaaaactctgttatagaagtcttcagtatatcagagacatgaaaaagaagggtccccatgcttccaattagatataggacattagtctcaccatcacctaggaagcttctatactggctgtgatgcttggtcccagcataagccctgtaactgcttgtcaggatgcaaagagcactgtaggagcagtaaggagactgtgctggtgtgtctgttctgctctgaactaatgtaggtaatggtgtgttttcaagcaaagttacttgacctccctcagccaccatttccacatctgtgaaataaaagtgatgatcttcctgaccccctgagttgacatctggggctcagaggtaaccctaaccgtaaccctttatgaccctctgagttgacatctggctctcagctgtggctctggtgtggctgagtggctctgccatctcagtgggccttgcctctccctggtcagactgaagcacaagctggttctcctgcagcaacagtgtgaagagaaacagcagctctttgagtccctccagtcagagttacaaatctatgaggcactttatggcaattccaagaaggggctgaaaggtatgtgttcttctcccctcaccccatgagctttttgcccttgcataggatgctagtgaggtctttcctttgggagttgtggagatcatgggaagctacagagttctgtctcagaaactcccacccgagcctggggctcccaataagaactctcatacacaaagcccaaggtgacaggttggtgacacgaacaagatccagcctgatcattcctaattattttaagaaaatctagacattcctatcaatgtctaaattataacatttttgaaagcaaaagaactgtcctaatgatatcatcatttgaaaaggcctttaatattgtcggtgatacatactgacaacccattcagcccaatgcagcaggcagtccgctcccaccctgaccctttccctagtgacatctggcgctcagcttattgccctctcatgtaattttcataaatcctgatttagtttcctgattttctaaagagaaggtgaactggaatttgaagaaatacaggggcttactaggctgagcgaatagcttaagtacaaagtcatggtgagtgttgagtcagtggggaccagcctgcccacaggagaaaattaaaagacacgaaaacaaaaaacccttatagaaataccactgataggacctaaatttcaatcctggatttaaatattaaggacatttattgaagactttgttgcctgctgaaataataatctaatatttgagaatttgatatatttcttcattctttaaatggagaagggtattcaaaacataatgtgaataagtcacagcaggctgggacagaggactgacatcaatgtcatgaaatttagcaaagataaaaagcaaaatcctgagctcgattaaaaatatcagtggtagaaatataggatgagggtagaaatataggacaggcggccattcgtggacttgagagtatggggtttggtagaaacatgatcacacaagtaagtcataggccagaggttgctagaaatgccagctcaaactgacactacagtagtgtaagtgtgatgttcacctgtggagaccatggtctaaaatattgttagattaaggggcactatctttgaaaagggcattgacacactagggaacataatgaagacagggcgcacaatggtgtggaccagaaatctccaactggtcaaagaaactaaagaaatgtaggctttcaaaagatcttgaggacatgagaactggcttcggatatttgaagaagtgtcaggtgaaaaagaactcatgtattttatgtccctccagggggctaaacaatgcgtgaagggcagtggaatttagattggaattatcataaatcctgatttagtttcctgattttctaaagagaaggtgaactggaacttgaagaaatagagggggctcaccaggctgggagaatagcttaagtacacagtcatggtgagtgttgggtcagtgggaccagcctgaccacaggagaagcttggggttgggggagtgagaagtcaggatggtggagtagagccaccaaaccgtgaaagctcacaggtcagggtgaaagttgacattctgtagagtagataatgaaactaagtctattctttttcaaagaagataagcatatgatgaaaacagaactttaggatgctaagtctcaggggatgtcctggaattgggagacattagaatctgggaaacctattgggtgggtctagtgatattgtgacacattaagagatgacagtctaatataaggtgctgttgggaagatgaaagggtatagatagattttaaaatgtctcttaaaaaaataagcaaaatttagtgagaacttggattgagaaagagagagaggaacatcataaaacttcgggcaaaattcaagagtagattacttaccaaagtctctgaaacgacttcatcctgagctccctttcctttcatgcttttctccctgccttttaggactcatttcaaagctacaaccactaaagctccataatcccttatctgtaatttcaaaattcaatacgatctccaaactaaatttttcaaatactcatttagtgacaaaatctagatgatctgacatgaggatattcataagtctttatttatctacttaggatattcacatagctcattgcagaaatagttatatgtttgattaaggattgtggttcacctgcaactgggtacatgttatatatgatatatgcaccctgttgccttgctaaaaactaaaacaaattttacctttcgaaatacatttggccttaaggttttcagataagggattgtagccttgtagaatatttcttagatctcttcatccccagtacaaagaaatagactacatgtggtgaatggaggtaaatatatgtacatatatatatttgtatatatatgtatctgtatatatgtgtgtatatatatgtacatgtatatatgtacatgtatacacctatatatagtatgtatatacacacacaacatatatatacacactatatgtaggtgtatatatatgtacacacacatacacacacacacacacacacacacatatatatatatatatatatatatatatatatatatatatatatatatatatatatgagagagagagagagagagaaattgaaaaactcagttataatccctggtctaatgtgcccaactcgcattctcacatgctaccaaaaggcctcctccttctcctctttcatttttgagagtgaagactgtgaaatctctttctccctcatcccctacccttctctagctcagtactgacgttctaccttggaggaccctatactttagcctacaggactaaggttactatggagatgaaatatggacttatccttatctgccaatcaaatgctctataggtgcatgtgtgtaacttaaaccgcaaggaagtttcagactggatgtgtgccatctcagtgccatcccccggccacacacagaaatggtgacatctccatcacagatgggttgcatgagactcagatgatagtggggtccttggcagaaaagaatgtcacagaggagggttctgacaagtgcttggaaatacttgggtcaatgttaccagactcctcttctctcttagcttacagcctggatgtctgtcaccaaatccctttgagcagtgacttgagccacctggtggcagaggtatgaggtctgagagggcagctggagaagagcattcaggggaacaattgtctgtgactgcagctgcaacagcagctggatagcctgctggcaaagccagcctcagcccctcctctgttaaccagaacttcccagccagcgctgaccctggaaacaagcagctgctcctccaaggtaggaaggaaaagggacttagaaagcccttggccagtggggagatcaccaggatgtctgtctggtccatgctccttatggtcaggttgaaatcagagatgctctagtctagcagcctgagtgaaagcgtgggatttaggtcagactgggctccagattctgagtttaccgcttagaggtcgtttgatttgggcaaggtgtttaaagtctcagaggtttaagccttagtttccttacatttaagatgaggataataataatatataccttatatgattttgaccattaaatgagatcatttacaagtgcttggcacactaagaattgctcaataattagcagctgtatatgttcatatctttttcttggatttgcttggtgctttagttttagccaagtgttttcacatatataatttcacctgaagtaaagcaggttttgctatctctgtatttcacatgagaaaatttaggtcctgagatattaacagacaagcgaggctttagagaagttatagacaaagccaggatcagaaccagatgttgtgattttcagtctgtgttccttccagctcattgtgccctgtctcagtattgccgaccttcccagattctctagtccccctttccctcacaggtggggaactcaactgtgtggcaaaatgttcctgcccctaaggaaacagggctctggggaagtcctggatggtgggtgatttatttcgggcggtcatcattcgctttctctaccccaccccttgcctgccttttcagataggcgtgtttgaccaggtcccccttctcttctcaatatcccccatcaatctcacttctcccagttttcattgaaatgtcaatggtgtccccctagtctcttaaatcattcaatttctacttcctctgtccttttctccttttgatacaccgtttagtacaccatctccactcacctccatggccataccttcaattttattcaaatcaggaaccacttctgttcagtttctctaaagctgagctttcaaactctcctgccagctatttctgggtcatgttaatctttatttttctctggttcttgtagatgctcatttatctgacagtaaccttatttgtcaaatgaaggtgacaataacatgattatgctgttttcagcttacattaggtggatgccttgcccttctctgggctgccctgatggttgtggtgttcagtgatgtctccaactcttccttctttctaaccaggccttcctctctctctggcttcccacacagcagccaagactcagccccactggtgcagtccctgcccatctttctctagcacccctgaggcctgagctggaaagcaggcactgggccacacttgcctgagtaggaccttttctaccttctttgtgatattttccaattcctccaccatagggttgctttttagtctccagcaagatgttaacccaccaagccctctctctccgttcttctcatacaagtcaatttctttcagtattacctcatcagaatgatgactagaatgttgagtttagtcccccatgaatccattcattccttgatcccttgattctagattttaatatgtactatgtatatttatacatattacatttagttacggggcatcgtattagataccacacacaaattatactcaagacttggtttataaaaatacacctaataatttttcaaactagaagttacattctcctggaacacccctcctttaaaggaatatctttttgttctgaagaatggaaacattctgaactcagtgactcatgggcttttgcttttgcttgtggggtatggataattctgtaagaggagagtcctgccaccttaggtctcagtggggacggctaggtgtgcatgtgcttcatgtgcagtgtgttccagggctcctgaaaactgtggttgcctttaccccctagattcagctgtgtcccctccagtccgggatgttggtatgaattccccagctctggtcctccccagctctgcttcctctactcctggctcagaaacggccataatcaacagaacacatggtaaatatggcaactaaagggcccagggactgatgttggaaagtgattaatgcaaacaaccttttgttgtctctaaacatattatctgtatttagagagttttctctgcatgccccaaggcctttagccctactccctgcaccttctgtggctgcctttcttgccattgttcatcctcctgtagttttcctactgctgtttttgcttcattgcaccataatctctctattcttgaaaatgctctctgtatccagcttgacttccctgtctgtgtcttctctacccagaaacttattatttatgattcatcctatttcatttgccaataaggaaaaaattgtctcctggcaaatttatcattaaaagataatgtaagaaaggttataaaaatatagaagccagaagatctctatggactttgccccacccttgtacattccaaggcttcctttcttgttcccagcctcgtccttttcttgttccctgcctcttttttagttggagcaaactgaggatatcattatgaataacagaagattctgttgtgttgtcattttctttttcaggcttgggtttggatacttctccagtaatgaaggcccctcccaagctggagggtgatgctactgatggctcctttgccaataagcatggctgccatgtcattggccacattgatgactacagtgccctaagacagcagattgcggagggcaagctgctggtcaaaaagatagtgtctcttgtgagatcagcgtgcagcttccctggccttgaagcccaaggcacaggggtaatcacacctgaagctttaggtgcactcttttcttgtgccctttcttcctttgatgttaactccttctcccaccatttttgttttttcatgctttgcatctctcaacagctgaggcttcctcttccatgcatagcagccaggccctttcttctctatttcctattttcactgtgagttctgctctgttccagatgtagctgactggatatttcccctcagccccacagaaacaggtggcattgcctagcagcctttggtagcttattatctaccacagtcatgcaggcacatgaccatatgtgggcagagtcaactcaatgggatggacagaaactgaaggatttgcaggtgtatggcccccacatgtggaaggggtgagaagcctggcagccaaggcatttccttgtgcagactgcataggggagggaaggcagtcagcgaagcttctgagagcaccttgccagtgagagagaccaggaacctgtggctatgctgtctgagctgctggagacccatggatgcatagggacagccctgcctccatggagcccccacactggaatgcaagacacacacccaagtagataagcacagtacggggctacaggcgcagtatgagaaatcatcctctgtgctgtgagagcaccaatgcaaatgtggtcatttatctcaggcaaggaaggtaacagattcatagaggacatagcaaggggggtgagttttgaaagccttgtgggttctgcaggtggaggaaggcattcctggtaaaaggagcagcaccttagttctgagagctgcaaatggttgtgcgagggcttcacaggttcaagcaggcccatgttctgcacctcactcacaaaggaagcttgagcccacgcagggggaaaaaagtaatctctccgctcctgtggtgttacctttccccaggtgctaggcagcaaaggcattcatgagctttggagcagcaccagtgccctgcaccatgccctagaggagtcggcttccctcctcaccatgttctggagagtggccctgccaagcacccacatccctgtgctgcctggcaaagtggtaagacgccagtgtcctttcttggttcaaacccagttctcctgccctccaatactgttctgtctcctcagtgtcacagcttttccagaaaatcaggagccacacagtgaattgggatagacaggaacttaaaggagtgtccctggagggacatctctgacccttggtggctgctttcattgcagctctaaatacatcccattccccaccagccccctgacccctggataagaaatcaaagaagaggaggaaggagtgtggagaaggcggagacatcataaccctggcaatccataaatgttcagtttctttacctctctgaagtttggatgagctgaaattcagttaaagctttagcacatctcccaccccacaggtcccgtggtcaaatgatcacagaatgcccccatgagactgagcctttttagccactgcctggaatcccaacatacaacttaagctggcattgctggaccaggcctggggaaagtcagcctcccctcaggatctgctcagagctcaggctaactctgattggcagaccctcatgtaggcaggtttcaggatcccctccccagggattctacttccaggtcaatggcaccaataccttttggatccaactatgctaattccagggagagggtgttgtgccatcttcatgttggcacaaatatttacaaacttgcaaactttcctgagtccagatctctctccccagcataacacttctgaactctcaatcttacctgtgaagggagagtgacagaactgatatcaggactaaagcaaggtcctcttcagagttgggagtttgataccagcctgaggcgaggttctcttaagctacaggtgtgtaggcctgtgctagtctgcatggggaattccagagtctcattattcctgcctaatggcctcatcctaaactgtcctcagctggaggtattcaaggctgtgaaggaggaaatccagttcaggagggttgagaagattgtagaatcctttgaactggaaagagccacaaagcacagggtgctttatgtcttctgcctggtcagtaagagtctgttcctcttatccagagagaatcgacagaaagggaacttctagaactgagaaccaaagtatccaaacaggagtggctccttcagagcacagctgagcatctgaagatcgccaaccagcagaaagagagcatggagcagttcatcgtcagccagcgtaggttccctgagagggaatgggggaagaaacgggcagtcttcccgatgccccacttgtgctgctgatgagcagtgactggggggcttggggatgttgggagttgaggctgatttgatgtccccaaacctcctgtgccccgagcagttgtggatgcagagggaggggaggacagggggtggatagcaggaaactccaagctgaatggccagagagaaataaatgctttagcattctcatgctaagcaagtagggttaatttctgctgatgatttctactctgtggtgctcttttgttgtttcagtaaccagaacacatgatgttttaaagaaggcaaggactaacctagagttaaggaaactactgcaccagtcagaggcaccaagcctgtccccaacccatcaccatctgttagcagatcttgtaggtgacgcttggcctgctttcgccttccaggagaagatttccagtccacttgtaagatcacaggtcctcagtgggcttcctgctagtttctgttcccatcaccctcccaccccatcagctcctgcccctgtatcttggttcactctcacattgtcctcatctctcctttttactccaatttttcttcgttgatgccaggtcaggagactggagaaatgcaattcagctcactctggaagtcattagacatttgggagtctgcctctgaatgagcttttggtagagggatcttgaggccagttatgtgttctactcttcatgaaaaagtaaaagcaatttgcaacctaataaactgatttcactgcacactcctgggttaagaacagcaatttgattttgatatttctttaagtaacacgacaaaagagatctgttgggtctcatttgtctaaaagagaatttgttaataaataacaactgaaccttcaggggaaaaatgttatatatatatcagacattatctacatttacttaaaacactaagtgtttaatcattccctaggaattgctttgaagaaaaacttgaggtatatgaaatggtttaaaaatcagaaactaaaccttttaacgtggacttcaaagctttgccataagcaattgagcatattcctagaaatgtttctaaaccataacctgagagaatgttgatctccatagtgtgaaaatgacttgggccagtttaacttgcacttttttttttctaaactaattccgttttgtttttctctgataattcttctctttcctgagcctctttagagcagcacttacaggattgcctctgtaaagccttattcctgtcccagaaaaggtaatccaaaaagtctctagtatccactgaaaggtaacccaaatgtttctagtatccactggttttctccagtgtggaagctttcccctccacctcccacagatcactggaaaggaccagaggcctcggtcctaatccctggcttatcactaactggtgtgtggctttggcttgtcccttagtctctgtgagactgctgcaccctcacctgtcaaagatggaactggacttagttgagctctgaggtccctgtggacttggcccctccacatcctcattatggcgactggacataaacttaacagaggacttccctgcagagtgtcctcttcttcctacaacaggctgcttctatatgtgcatgtttcatgctaagcacttctttcttgggtggagatgacaaaggcccctttctgctgagacaaagtgatttggagagtcacttggcccctgaagagggagtggtaggatccagccacccagtgtgcagtgaattggagcagggatctcaggacacagggaggtggggaggctccccctaacctcgggcacctgttgcttctccagactgcagtgcatgctcttagctcatcctcttaactggctctcactgtgctcctggctttggtcaccccatagttctcactccagcttcgggtagccatcagtagggcctggcaatatacactgatttggtttgttttatgtttgtctgcaggtgaaatccctaagggctctgccatgtactccagccttgtgacccttgccttccaggaaccatgcaagaagcgcagccaccggaagtccttaaaacagcaggaaaggttggcctgtcccccttttgtgcagctacctatctgctgaggagcatctgggcctcattcctccaagtccactggagggtccagaagagggagtcagagttgtatcctggtggagctggcagaaaggcagaaagcctttctgacagctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattctgatgaatggggcacgtggtcctattgctggagctcctctggcaggttctaaaagcacactacggagcagcggtgccctgccagacactgctcgtgggggctcagtgagcactactcacagatccacacctgaccctgttgggtcaagtcaggctgggttttggtctgcactgtagcacctgcgttctttgagttcacatcatgaatgtggtgacttcccagataccatctcaggcttaacctagcacatcctatttcttttcttctatgatatccaaattggactgacctcacttcaaatatcttgtcccattttgtcgtcctatcttacctcggggaaattggggactgatggccagaccaattctgttgaaattcttgcatagagcaaacctgtgctcatttttaagtggcatgggagaggcccccagccatagtaaagcctagtctgtgtcttcacagttttgatagaatgtgcttgtgtgtatagatgtatgatacagatttatttatgttgctatcgccatatattgaaggccaacataactggtggacagggtgggtgacagaaaatgaaagtctttttggtgattgttaaagcaagatgtgtataaagaaataaatagtttttctttcactgctttgtttcccatttctgccccaattccttgacagtataaagaactggaaagagaaaatgggaaagacaaactgtgtttaagaagtgcacagtctaatgcttgaactctaactttaaaagattaaggttttccttctttgtcattttgtaagaatccccagtctgaaaatatgaaagaatggttcttaaacttggtgtaccttagaagcagctgtggagattataggaactacctcctggtctccaatcccaggagatttagttggtgtgagccctagaatctgcatttttttaatataagcaccccaggtgattccattacatgtgggctgcagataacagtttaaaaaaacagtgttctataacattgaatcaaaactaaaactacatttaagaaccttgaatcaaaaagtatgtcattccataaacattgatataaaaattttaaaatattccttgggaaaagttcttagctacatgcttttgatccccaagattaaaataaacgtatcacttcacaattatttactagaaacatttaaaaaataaacaggtaaaaggtggagtaagatggtagaatagaattctccagcaatggtctccctgaaggaacatcaaattgaacaactatctatgcaagaaaacactctcacgagggctaaccaggtgagagatcatagcacctggttttaacatgataacaagaaaagatgcattgaagaagggaggaaggacagtcttgcattgcctatgacacctctcccccaaccacaggaaattctctgagagagaatctaatggcttggggacaaagaggaaaatgtgggactttatattgaaacttagtcttgccatagtgacacatgacactggacagaaccccacagcacttgattccaggctggtgcccacaaaagaagcatttagacccaccctgggccacaggggaatcagctaccccaggaggaagaacccaccaaaattctggccagctttatcactggaaatttattgggctacaaataaatttcagtggcaggcaggctgtagtggccgcagtccttgggcaagccctgatgctgcataggtctggaacaccctggacttgtggtgtgagccagtatgacggcagcagctgcagcagctatggaaatgcctgtatcacacctccccacactccaggcagtgcagcctgaagagagattccttttgcttgggggaaagaaaggaaagtaagctaggggctttacctgggaatgcagagaataatccctgatctttcccaagtccacagggctggagacctaacaatctgtaagaattgcagtgtacctgggcctagggtgccctgtagtacaaaaatggctgcagtgatcactggcttagggaactcgtcagcccactttgaattcctggaaggtcctctgaaggacaggtagaaacaagacctgactgcaaaggctggaataaataccttatccttcaatgcccagatattgacaaacatcaacagtatcaataacattgaagccaatatgacctcaacaaatggaccaagtaaggcactcagtgacaaaccctggagagatggagatgtgtaacctctcagggaattcagaatagctattttgagaaagctcaatgaacttcaagaaaacacagagaaacaattcagaaatatatcagaaatttaacaagattactgaagtaagagaaaaaaatcaaatgctggagctggaaaatgcattagtgggtctcagtagaattgatcaagcagaagaaagaattagtgagcatgcaaacaagctatttgaaaatacagtcagaggagaaaaaagaaaagaagaatgagcaggaacacagaatgcttaagagatctagaagagggcctgaaaagagaaaatcaaagattcattggccttaaagagggagttgagaaggagcaaagagtagaacgcttattcaaagaaataatcttttttttaaaaaaatactttaagttctagggtatatgtgcacaacgtgcaggtttgttatataggtgtacgtgtgccatgttggtttgctgcacccatcaactcatcatttacattaggtatgtctcctaacgctatccttcccccagcctcctaccccacaacaggccccagtgtgtgatgttcccctccctgtgtccatgtgttctcattggtcaactcccacttaagagtgagaacatgcggagtttggttttctgtccttgtgatattttgctgagaatcacgatttctagcttcatgcatgtccctgcaaaagacatgaactcatccttttttatggctgcatagtattctttggtgtatatgtgccacattttctttatctagtctattattgacggacatttgggttagttccaagtctttgctattgtgaatagtgcctcaataaacataggtgtgcacatgtctttatagtagcatgatttataatcctttgggtattcacccagtaatgagattgctgggtcaaatggtatttctagttctagatccttgaggaattgccacactgtcttccacaatggttgaactaatttatactcccaccaagagtgtaaaagcgttcctatttctccacatcctctacagcatctgttgtttcctgactttttaatgatcatcattctaactggcatgagtggtatctcattgtggttttgatttgcatttctctgatgaccagtgatgatgagcattttttcatatgtctgttggctgcataaatgtcttcttttgagaagtgtctgttcatatcctttgccctctttttgatggggttttttttttttcttgtaaatttgttgaagttctttgtagattctggatattagccctttgtcagatggatagattgcaaaaattttctcccattctgtcggttgcctgttctctctgatgatagtttcttttgctgtgcagaagctctttagtttaattagatcccatttgtcaattttggcttttgttgccattgcttttggtgttttgatcatgaagtctttgcccatgcctatgtcctgaatggtattacctaggttttcttctagggttttcatggtgttatgacttacatttaagtctttaatccatcttgagttaatttttgtgtaaggtgtaaggaatggatccagtttcagctttctacgtatggctagccagtttttccagcactatttattaaatagggaatcctttccctattgcttgtttttgtcattttgtcaaagatcagatggttgtagacgtgtggtgttatttctgaggcctctgttctgttccattggtctatatctctgttttggtaccagtaccatgctgttttgtttactgtagccttgtagtatagtttgaagtcaggtagcatgatgcctccagctttgttctttttgcttaggattatgttggctatgagggcccttttttggttccatatgaagtttaaagtagttttttttccagttctgtgaagaaagtcagtggtagcttgatggggatggcattgaatctataaattaccttgggcagtatggccattttcatgatattgattcttcctatccatgagcatggaatgttcttccatttgtttgcgtcctcttttactgattgtttgctgaaagtttgctgaattcgcttattaactctagtagtgtgtgtatgtgagtgtgtgtgtgtgtgtgtgtgtgtctggcctctgtgtgcatgtatgtgtgtttgcatctgtaggtattatttgggattttctatgcataggatcacaccatctgcaaattgagatcattttgttttctgttcaaaaatactttttctcatgtttatttttaaaagataatttggccaggtgtagaattgtaggtgacagtttttcttttttttaagtactttattgcaaacttcttgtttgtatgagaaatcttatgccatcattatatttagtgctctgtatgtaacatgttctttccctttttattcttcttaggatttcctttttatcactggttttgatggatttgattaaggcgttccttggtgaagttttcttcatgtttcttgttcttagaataatcatatttctgtaatatttgaagtttatggtttccatggagcttctaaatctttcatccagtatgttttaaatatctttgtctctcttctccactacacgcccttcagggattccatttagccctatactagggggtttaaagttttgatgccgatggtctttttatgttttcatgtcatttgttactgtgtgtttgatttatgttagtttcaacttgtattccttctagttcaataatcttctcttctgcaatgtttaatccactgccttcttccatttcagactgtaaatcatactttttatttacagaatttgatatttaaaaaatcttcaacctccctatttaattaaaatacaattatactaactgctctaatgttcttttcttctatttccaacatgtctgtcaatttcaactagattattagattcttcattatgtgtcatgttttcctgcttctttggctgcttgatattcttttatttttatttatttttttttgcggggggatagcgttttgctctcgttgcccaggctggagtgcaatggtgtgatctcagctcactgcaacctccacctcccaggtacacaagcgattctcctgtctcagcctcccaagtagctcagattacaggcatgcaccatcatgcctggctaatttttttgtatttagtagagatggggtttcaccatgttagtcaggctggtcgtgaactcctgacctcaggtgatccatctggctgcttgatattctaagatttgatgctggaactttggtgtcaatgctcaaaatgcccaaagacaccactcaacctcagtgtctatgcacacccaagcttttgcagcaggacaggtagagcacagatgagtgtgctacaacatgctggtagaaggtacccccaattgtgcttggggatttcctattcctcatgcaaaaatgtgtcttccttaatttttcccataagaaccaccctacttcatgccctgtctctctgtccaaacaccaggacagtcctctcaccagtctcaaccacccaatggattgacaaaggtgcaaatatgattcagtggagaaggcattctcttgtcaacaaattgtgtagaaacaactttttttacacaatttgtttttctttatccccataggaaaaaaattcacctgaacctcaatactaactcaaaaattaactcaaaatggattatgcaactaaatataaactataaaactagaaaaagtatagcagaaaatataagacaaaatcttcatgacacagagttaggcaaagtgttctttattatcaataaacacaaaccattgaagaaaacattgataaattcgactttataaaaattaaaagtttttgctcaacagtattaagagaacaaatataagctgcagtttgggagaaaaacagtggaaatcaccaatatgacaaagggcatgtgtgatagttacttgtagttgtcactgtgaccgagcaccagggtgccaggacatttggccaaacatgattctggttgtgttccagagagtctttcagatacgattaacattgggatgggcagactaagtgaagcagattgccctccttaataggggtgggcctcatgcaatcaatcaagggccaggagagaattaagaggcctaatgggaaacaaatgctttcctggatatccagctttccttccatcttgggaatttcagcctccataatctcagaagcaaattcatgtatatatatacacacacatatacatttcataggtatgtggctaagattgtatttttacaagttcagccatgagatgattggtgaagccagccaatgaataagggtgtgttctattatacgattcagtcttcttttgtaaacgattgaagttctgcatttgaagtaggaggataggagggagcaagtccacctaggatgataacagctgaatttctcaacttacacttcagagccataggggtcaacttagagactcaaaaatctcacccataatcctgccctaaacaccagggctagggaacactgtggccctcaggtgattttctttagccaggactgggagccacacgacggcagagggagcaggaaacactatgcaaatagaggccaggacagcagggagggcctgttcatgatagaacccaggcaaaactctcctcagaaagcgagtgtggagaaacatagatcatgcctgagacctggtggattagagcactggctactggggaattgaaaggaaggggcttcaccgtgcagaggaccagaggtgccaatcttggaaatgcagaattgctgggagatggggaggcacggaccatggaagtatcctctggagactcatggcgaagagaacaaatgaatgaagtaactggcagaaattagaggtcctggtagaacaaaatagaatcccacaatgagaacatacaccatgtatgtcccccaaggatgacaatatctcctaaaagctccagaaaaatcattttggacaagcaccttatatctagtaatgtgatccatgtatcgagaccgtgagaaaagattattaaacatgctaaactcagcgagacctgattccctcatgaggactctgttaaggatgagtaccactcagcaagtgatgacagtgacattcacttttgaatagctcatgagcgttaatatatttcattatggatctaaaccacaatggataaaaaccaaggtaggggcaggatgataatcacagaatgtcaccggtatatgtttaggttcaaatactattatgagaagtggcaggtaaaggaggtaggaaaaagaaaacacatcatgtaattgactgttgtatggaaatatttgatgctgaaagttataatttaaaactataaaccaaatattagaagtgtgtctagttcaaagggaggaaaaccatcaaaaacatttttagtgcaatatttaacatgagctatacaacccttcctaaatgccaaaggcacacacagacacacacacagacacacacacacacacacactcacgaagaatacaaatgactagaaccaagaaatgtaaatacattctgctacgtatggtaaacatagcctacaatgtggaagagattagaaaataaacatggaaatgaaatgtttttattaattcgcatcagtacccaccaaaaccaatcagcataatcaaatattataacactgaatgtaaaaaacaatccaaaagtccagagtgataggcaaaaggttttaattgtatagattaaaattaactttggacaaaaattaaaactcaggcaaagaatgttttcttctttttgcaacagcagacactagtaaaaacaaaggcacagtaaaaattgagacccaaaatttgcagcgtagagatatgaatataataatagacacaggcagggaggattaataaatgataaaatgtttagaggatgatcattagaatacaggatatttatactcttgaaaaccactttcccaagtacttcattataagtaaggtgtctctaaaagggacagatctcctagacccctccttaaccaagtaaccagtcctgatatcataatggtgttggacaaactagaccttctctgcccgcagatgggctgaggttggaaactcacagcattgtctctgcagtgttcccgtcaaaaagtttaggctgaatttaatcatgaagacattttcagacaacttcagaatgtagatcattgagccagacagctgacctgtcctctataaacaagtccatgtcaccaccatccatgacaacaacaaaaagatgaggaaatatttggggttcaaaataactaaagaaatgcagctacattatctttttactttttttcaacccaaaatatctcttctcctttttgttgtgtgatttgtggtgatatggactatgtgaaggagacaggtcagttgtcctgctcagtgttctacattctgcagttgtctggtgattacctcctatgaaactcaggctaagcgttttctgcaagaacatggcattgctcatattctgcaccggcagagtcctgggtgacatgctgtctcctgccagcggctcctgactcctgttctctacaggatggaattgagaggagcagggctaaggcctcccaatgctgtttgtccatctagctgtggtcttcctaagtactgacaccaattggaggctgaaggactgtggcttctctaaccaaaggagcctagcgggttaacaattgtcaagagcagttggtggttctgaaatacaatcctcagccaaggatccctcctgtgttacagatggatcagctaaaacaagccaacactgaagacacaaagaatgaggttaggttcattgaaaccagggtaacacctttggatgagctaaacacaaagatgacactgaccttgagcaggtatagaagctcagagacatgcctgcaaaatgaaatccctgaggaattttgtagctacccagagatacgtggttcaaattaaaatgtccgactgatcactcccggcatgtgctgcacagttatgtgaacgtgtcacacctaacgtgggtccattgtcttcagactgagcacaggttgccactggcatgctctgagaataggaatagagccatgcccactgacccatcctatgtctgggcttccaaatggaactatagtttcattcaaatcttcaggtgcctataggtcctgcctgcaggaatgacacctctcggcttagtaagggctgcttattgtgggaatatgactcccatctggaagaccaggtggagacttctcaccgtcaaagtaaaaaacctattgtccatgtcaagggcaaagctgatgtgctgttcctcaaatgagtaaaacacacttctgtagtgctggaatgagtcaggtagttcaaagtacattgatggagtcgaataatatctatccagtgagtcctgtaagacttcaggcacttccacttccatcagcacgctgctgagcctggaaaaggagacaaaactaaagaagcagccagggaaaatcagacaccacagagccccactagatttcagaagtaacataaggaagtggttggaaaagaaaaaggacagatccattaatgaggtaacaaattattgcctttatgttgggatagaacagggccaggtagaaaacaatgaaagagaaagacagagagagagagacagagacagagacagagacagagacagagacagagacagagagaaagtgagctagtgaattggccaggtgacatactggtaagggagtcaaaggacactctgacttagtgccctcatgacacacagcaaactgtgatcatgaaaagagtgagctcaatagttttccataaaatatgctcaaaattcgatgcagtggccatgagagtacagcttttgaagtatggtccacctatggtacgttagtaaatgataaggggaggaagaaatggaaacctaaacatctactgcaatgaaaaccaacaacaatgacagtaggagtaattcagccttcgttgaaaacatgacatcaaacacactctggtttccctgaatctgttgcctccaggtgttaacacagaattaagcatccacaattgctgaaagttacctggggcatggtgggttttgatcttcttccccttcttttcttccccttcttcttttcttctttgatcttcttccccttcttttcttccccttccccttcttttcaatttctgcaataaattcagacatggacagacacattaagctgattcccctacacacataacaatccactgtctaatcctcacacagggacctcaggctcctcagcataagaataggacactgtgagagatatatttcaggaggcctgaaggctggtcgtgatagaaattcctcggtttttctcccagaaactctgggtaaaatgtccctattctagtagatcattatcccaatatcatttgtcccaagtttgtgcaaacagttatgccttatttttccaatcaatttaaagcaaataccctcaaatgatttctaggagaaaaactgcaatatttagccctgtctcatcaaatactcagattgttcatggttgtgaggactccagacactgaaattagagtgaaaaaggaaatctacaaaccctcgagtcaaaatcatagttctctgaatttgtcacatctgcccaggtccaatgtcatgagagtagaatcagagtgccacaggcatggcctgagactaggaagagagccatgctcactgacccatcccatgtctgggcttccaggtagaactagagtttcattcaacctacatgtgcctataggtcctcactgcggcaatgacatctctcagctcagtaatggccacttggagcaggaatatgatctttatatggaagactcagtggatccttatcaccttcatagaaaggtactcacctcccacgtcaagagaaaagccaacatgtttttcctccaatgcataaaaggaacttccgtagggctggcaggagtcaggctgttcaagacaactggaaggagttgaataacatccagtgagtcctgcaagacttcaggctctactacctccagcagctccctgctgagcctggaaaaggaggaaaaagtaaagaataagccaggggaaatcacacacaacagagccccaactaggtttcatgggtagcataaggaagtggttaaaaaagtaaaaggatagatctattaatgaggtaacaaattattgccttcatgttgggacagaacagggccaaatggaaaagaatgaaagagaaagacagacacacacacacacacacacacacacaaacacacacacaaagacacacacacacactgagagagagagagaaaacgagctcagtgaattgtccaggtgacacactgatgagggagtaacaggacactctgagttagtgccctcaggacacacagcatacagtgatcatgaaaagactgtgctcaataattttccataaaatgtgctcaagtttccatgcagtcaccatgagaatacagtttttgaagtctggtccacctgcagtaggttagtaaatgataaggggaggaagaaatggaaacctaaatatctactgcaatgaaaaccaacagcaatgttagtaggaataattcaggcttggttgaaaagatgtaatcgataatgtcagcccgctctgttttccctgaaccaggagtctccagatgtcaacacagaagtagctgttcacaattgctcagttacctggggcacggtgggccttggtcttcttcctcttcttggtcctttttaattcctgcaatacattcagacagggacagacaaaataagccaattcacctacacccataacagtccactgtctaatccccacacagggatctcaggctcctcagcatgagaacaggacaatgtgagggatatacttcaggaggcctgaaagctggtcatgatattctttggtttgcatctcagaaccaagggtgaaatatccctattctggtagatcgttatcccaaaatcatttatcccaagtttgtgcaaacagttatgccttattgttcccatcagttcaaagaaaatgccccagaggatttctaggaggaaaactaaagtattcagccctgtctcatcaaatgcccagctcgttcacggatgcaagaattttagacactgaaattacaatgaaggaggaaatctacaaacccttgagtccaaatcatagttctgtgaattttttacatctgcctgggtccaatgtgctgagagtgggctcaggttgccataggcatggctggagactaggaatagagccttgctcactgacccatttcatgtctaggcttccagctgagactacagtttcattacaacctatatgcacccataggtcctgcctgtggcaatgaagtctctcgggtcagtaagggccacttggaacaggaatatcacccctatctggaaggccaggtggaggcttatcaccttcatagtaaggtactcactgtccacgtcaagagccaagccaaggtactgttcctccaatgagtaaacagcacttctgtagggctggcctaagtcaggcagttcaagataacctgaaggagtcgaataacatctatccagtgagtcctgcaagacttcaggctctttctcagccagcagctccctgctgagcctggaaaagtaggaaaaagtaaagaataagccagggggaatcagaaaccacacagccccagctagatttcatggctaacataaggaactgtttaaaaagaaaaaggacagatccattaatgaggtaatgaattattgcctttatgttgggatagaccagggccaggtagaaaagaatgaaagagaaagacagggagagggagagagagagagaggagaaagtgagctcagcgaattggccgggtgacacactgatgaaggggtcaaaggacactctgagttagtgccctcgggacacacagcgaacagtgatcatgaaaagagtgggctcaataattttccataaacttgctcaagattccatgcagttgccatacggcctttgaggtatggtcaacctatagtaagttagtaaatgacaaggggaggaagaaatggaaacctaaacatctactgcaatgaaaaccaacagcaatgtcagtgggagtaattcaaccttcgtggaaaacatgaaattgaacacactcttgttttccctggacctggcatctccaggtgtcaacacagaattaagcatccataattgctcaaagttacctggggcatgatgggtcttggtcttcttccacttcttggtacttttcaatttctgcaataagttcagacatggacagacatatgaagctggttctcctacacacataacaatccactgtctaatcctcacacagggacttcaggctcctcagcatgagaataggacactgtgagagatattcttcaggaggcctgaaggctgatcatgatagagattccttggtttttgtcccagaaactctgggtaaacttccctattctggtagatcgttatcccaatatcatttgtcccaagtttgtgcaaatggttatgccatatttttccaatcgatttaaagcaaatgcccccaaatggttgctaggagaaaaactgcactattcagccctgtctcatcaaatactcagattgttcatggtagtgaggattttagatgctgaaagtagagtgaaggatgaaatctacaagatctacagaattgagacaaaatcagagttgtgtgaatttgtcacatctgcccagatccaacatcttgagagtaggattagggtgccacaggcatggcctgagactaggaagagagccttgctcactgacccatcccttgtctgggcttccaagtggaactagagtttcactcaacctacatgtgcctataggtcctccctgtggcaatgacatctctcagctcagtaagggccacttgcagtaggaatatgaccctaaacagaagactcagtggatccttatcaccttcatagaaaggtactcaccatccatgtcaacagccaagccaatacgctgttgctccaatacgtaaaaggcacttctgtagggctggcatgagtcagtcagtccaagataaactgaaggagttgaataacatctatccagtgagtcctgcaagacttcaggctctttctcatccagcagctccctgctgagcctggaaaagtgggaaaaagtaaagaataagccagggggaatcagaaaccacacagccccagctagatttcatggctaacatgaggaagagtttgaaaagaaaaaggacagatccattaatgaggtaacaaattattgcctttatgttgggatagactagggccaggtagaaaaggatgaaagagaaagacacacacacacacacacacacacacacacacacacacacacacacacacagtgtgagctcagtcaattggccaggtgacacactgatgagggagtcaaaggacactctgtatttgtgctctcaggacacacagtgaacagtgatcatgaaaagcatggcctcaataattttgcataaaatgtgctcaagtttccctgcagtcaccatgagaatacagcttttgaggtatggtcaaccttcactaggttagtaaatgataagggtaggaagaaatggaaacctaaacatttactctaatgagaaccaaaaaacaatgcagtaggcataattcagacttgtctgacaagacaaaatcatgattttcagcgtgtactgttttccctggacttggcatctccaggtgtcaacatcaaattaactgtccacaatttctcagactcacctgggacctgttgcctcttggtcctcctttttcacttgatcccaccgatgtcctgcaaataaattcagatggggcctcttacattaagcagttcttccttgcacacagaaacattcctctgtccaatcctaacacagggacatcagtcttgtcagtgtgaaaacaggagactttgagagaaatattccagtaggcctgaggtcaagtcttgagaaaactggcttgggttctttcatgagccttgggcaaaattcccctgtgttggaatgttattttccctatgtgctctgtcctaggtttatgtacacaaatgagcaattttttccccaataaattgtaggcaaatagttctaacacctcataggagagatacttcaatattaagctttctctcatcaaatacccagaatttgatagtttatgagattgtggacacagagatttgatgaaggggtgcaatgtaccagctcttgagtcaaaatgaaacttggttctacacagaagcatcagctattatggcttttgtgggtgaaaagtaagccatttatctagaaaacataccaggaacatgacggacagatgagctaaaacaagcgaacttagaagacacagaaaatggggataaattcagtgaaacctgggtcacatctttcactgagaggtagacaagggtgacactggccttgggcaggtaaagaaccacacagacatgctttgggaacaaaactcataaggaattttgtagctggcaagagacatttaattcagatgagctgatctgacagacaactcctgggcatgtgctgcacagtttggtgtgagtttgccacacctgccttgagttcaatgtcgtgacagtcagtccaggttggcatgggcatggcctgagactaggaagagagcaaagctcactgacccaccccatgcctgtgcttcagactcgactccagagtgattgaaatctacattgatatataggttcagcccacagtgatggcaactctcagcccaaccaggggcacaaggcccaaagattatggggtctacctgggccatgaactggagctttatcaccttcacaatggagtactcactgcctatgtcaacagccatgcagacttgctgttcctctaatgagtgaaatgtgctgctgtaagactggtacgaggccaacctttcaggaggaattgagagagtcgaataaccttcatcccaggactcctgggggacttcctcctcttcagactcctgcagattcctgatgagccaggcaggacagggatgatagaagatttaaccaacagacattagacaacaaaacctcccagatgatctgatgggagacagaatggagtggtcacagaaaccaaaggcatttttccttcaagagaaataaaactatccttctaaatacagggtggagggtgactgctctggggacagagcaaaaatgggcagcatgtgctcagtacatttgccacagatgagccaactcagggcacccagactctccctgtaaactaccatcatgacttgcagcacagagaactgacacagggcttcaactactttgcataaattgggttgaattttacacgcagcattcaagtgaagagagttcttgacgcagtgcagacacagatcttgtgtattaagggccccattttcccaatattttgatataatatatttactttttcaatttcttttcttgcaaaaatactagccaacatactaccaacaaatgggaagaaagcatatatacatctctccctggatttaaacacatgggagagaataggcgacaccaagaaatctctgtttgagggtctggagtggacttccagcaaactccaacagacctgaagctgagggacctgactgttagaaggaaaactaacacacagaaagggatagcatcaacatcaacaaaaaagacatccaccccaaaaccccatctgtaggtcaccatcatcaaagaccaagggtagataaaaccacaaaggtggggagaaaccagagcacaaaagctgaaaattccaaaaacctgacatcccttctcctccaaaggatcgcagctcctcgccagcaatggaacaaagcaggatagagaatgactttgacgagctgacagaagtaggcttcagaaagtcggtaataacaaacttctctgagctaaaggaggatgtgcgaactcatcgcaaggaagctaaaaaccttaaaaaaagattagacgaatggctaaccagaatgaacagtgtagagaagaccttaaatgacctgatggagctgaaaaccatggcacgaaaactacgtgatgcatgcacaagcttcagtagccaattcgatcaagtgcaagaaacggtatcagtgattcaagatcaaattagtgaaatgaagcgagaagagaaatttagagaaaaaagagtaaaaagaaatgaacaagcctccaataaatatgggactatgtgaaaagaccaaatctacgtttgattggtgtactgaaagtgacggggagaatggaaccaagctgggaaacattcttcaggatattatccaggaggacttccccaacctagcaaggaaggccaacattcaaattcaggaaacacagagaacaccataaagatactcctcgagaagagcaaccccaggacacataattgtcagattcaccaaggttgaaatgaaggaaaaaatgctaagggcagccagagagaaaggtcggattacccacagagggaagcccatcagactagcagcagatctcttggcacaaaccctacaagccagaagagagtgggagcaatattcaacattcttttttttccatatgtatagttttcctttattattttttgtgtgtatgtatatatatatattttaatactttaagtcttagggtacacgtgcacaacgtgcagcttagttacatatgtatacatgtccacattggtgtgcttcacccattaactcatcatttaacattaggtatatctcctaatgctacccctcctccctccccccaccctacaacaggccccagtgtgtgatgttccccttcctgtgtccatgtgttctcattgttcaattcccacctgtgagtaagaacatgcggtatttggttttttgtccttgcaatagtttgctgagaatgatggtttccagcttcatccatgcccctacaaaggacatgaactcatcattttttatagctgcatagtattccatggtgtatatgtgccacattttcttaatccagtctatcattgctggatatttggcttggttccaagtctttgctattgtgaatagagccgcaataaacatatgtgtgcatgtgtctttacagcagcatgatttataatcctttgggtatacacccagtaatgggatggctgggtcaaatggtatttctagttctagatccctgaggaattgccacactgccttccacaatcgttgaactagtttacagtcccaccaacagtgtaaaagtgttcctatttctccacatcctctccagcaccttcaacattcttaaagaaaagaattttcaaccaagaatttcatatccagccaaacaaagcttcataagtgaaggagaaataaatcctttacagagaagcaaatgctgagagattttgtcaccaccaggcctgcccaaaaagagctcctaaaggaagcactaaacatggaaaggaacaaccggtaccagccactgcaaaaacatgccaaactctaaagaccattgacgctaggaagaaactgcatcaactaacgggtgaaataaccagcaaacatcataacgacaggatcaaattcacacataaccatattaaccttaaatgtaaaggggctaaatgccccagttaaaaaacacagaatggcaaattggataaagagtcaagacccatcagtgtgctgtactcagaaaacccatctcacatgcagagacacacataggctcaaaataaagggatggaggaagatctaccaagcaaatggaaagcaaaaaaacgcaggggttgcaatcctagtctctgataaaacagactttaaaccaacaaagatcaaaagagacaaagaaggccactacataatggtaaagggatcaattcaacaagaagagttaactatcctaaatatatatgcaccctatacaggagcacccagattcataaagcaagtcctgagagacctacaaagagatttagactccacacaatcatcatgggagactttaacaccccactgtcaatattagacagatcaatgagacagaagcttaacaaggatatccaggacttgaactcagctctgcaccaagcagacctaaaagacatctacagaactctccaccccaaatcaacagaatatacattcttctcagcatcacatcacacttattccaaaattgaccacatagttggaggtaaagcactcgtcagcaaatgtaaaagaatggaaatcacaacaaactgtcagaccacagtgcaatcaaattagaactcaggattaagaaactcactgaaaactgcacaactacatggaaactcaacaacctgctcctgaatgactactgggaaaataacaaaatgaaggcagaaataaagatgttctttgaaaccaatgagaacaaagacacaacataccagaatctctgggacacatttaaagcaatgtgtagagggaaaattatagcactaaatgcccacaagagaaagcagaaaagatctaaaattgacaccctaacatcacaattaaaataactagagaagcaaagcaaacaaattcaaaagctagcagaagacaagaagtaactaagatcagagcagaactaaaggagatagagacacaaaaaacccttcaaaaaatcaatgaatccagggctggttttttgaaaagatcaacaagaaaaccctgtttggctagttcacctggctcatctgatggcaagttcctatcttgagaggactatgaaattaaaaccaacacaagtgccacaaatgacatacaacattgtaaatcagcacaatttgtagctgggtgaatggaagaaatagttctattcatcacttcctcattttccctaaatctacaatctccagatgtcactactgaattaacagccaacaattccacaacattacctgggagacactggccctttttcttcctcttcctcatcatcactttcattttctgtaaataaattcagagaagcaggtcacattaagcaattcatacttcacatatgaacaaatcactgtccagtcatagcacaaggacataactattctcagtgcaagaataaggattctgacaggaatattctagggtgccctagattaactttggtgagaattagatgaccctgctttccagacccacaggccaaaatctccctctacgtgtagaccataatgccatattccctgcctgagtcaaagttaaacaaaattttttccccaaaaaaatctccaaaaattggtcaaacaattttctaagagtgttgctgcaatacggacttatatcaccaggtaacatggacattaaatgtttagaggcatctatacatgaaacacgactgatagataaatttgaacaactcttgctttaaaaagcatctgtgatttgggaggccaagacaggtgaatcatttgaggtcatgagttcaggactaccctggccaatatggggaaaccctgtctctactaaaaatacaaaaattagccagatgtgatgttgtgcacctgtggtcccagcaactcaggaggctgaggcaggagaatcacttgaatctgggaggcagaggttgcaccaagtcaagatggtgccactgcactccagcctaggtgacagagcaggactccatcacaaaaaaaaaaaaaaaaaaaaaaaaaaaaaaaaaaatctacgacgctacaaagaaacattggatcagccattgcattgacagggtggagaaccagggtccagccttgctttatggaaatatatcagcaaagtaaagaagaaaagtttccatcctgatttcagggtgactgtgcagctaagcaagctgacttaaaggagatccagatgaaagctgagagcagtgaaacctggggaacaatatttccaaatacaaaggcaaggctgccaggttccttaaacaggcatagaaactccatggacattgttcagggacagatgactaaatcacagatgacaagagatactgaatcgaagttaggaggcctgacagatactgcctgtgcacctcctgcactgaggtgactatgagattgtcacacttgcctggggtcgagtaacttgatactggggactggcaaacaaaggcatgacattagctgagaaggacaaaaaaactccctgatatctgtttagaaacccatcacagttttttattcaaatgaatttgtgtttatagagcctgtcttcagagtttatcttcctcagcctagagagaggtatgagacacaaggaaaacagaggctacctgggataatgtgtacagcatcctcccattcaacatgagaggatgagccaatgagagttgagtcgactttgtcttcctcaaatgtgattttggtttttctatgtggctggttggagtcataagggccatggctatttgaacaagtgatggcacactcctccagtgagtcctcagggacttccttttcttcagccttctgcatctccctgatgagccaggtgggacagagatgacagaagattaaacacagagggattggaccccagggagtcctagctggttttgacaggcggcattaagagagtggtcccagaaagcaaaatggacgttcccattaagagggaacatgcaatcctgttctgtctgcaacagagcatggctgccatgggaaccagagaggaagagagcagctgctgttcattgcactggacagataggagctgaggaggatgaagactcagctatccctgtacggtgcagacatgacactcggcacacatagagaaacatgacagctgccgcaccctgtgtctaagctgggttatatttcacatactgtggccaagcgaatgcgggtttttggcccatcatacatgccagagagggtgtgcctcctagatattcttcatatgttaccatccattaattgttcctgagtattcagtgttacctgggggaagacgatttctgcactttctcagccacctcaacttgaacatcttcatcgtcatcgttatcattttctgtaaatacagaagtgttcattcagatatttcccacttcacagtctgcaagcacagtcagcccaatgtgcaacagggacatgaacatctaggcatgggtcaccgttcaactgaaaactctcatgttttatctttaacagaatgccctggcatggtttcctggtccatcaggcaatgcatttctgatctggagggccaccatcaagatgtggccaaatattgaaaagaccttttgcttcccatatcactggaggcttgtgcagcctctctctggactttggcagctgtctcccccatcctgccagatctgattcccaggcacaggcttggtgtcctgtcacagtttgcatttcaaacctaattctttctcttagaagcaaacttgtcccacagtcctctatgcatcagaagatttcaagcctccaagtggcttctgctgtgttattcagggacattctatccatggggagtgctccagtctgaagcacttcctaccacaaaatgcccccacatcaagtgccttctccaacaccacacggagaggggcttcatctcattttggaaagcagttgtaagtgttcccacatttgaatgcttcagaccttgcaagagacaatttgtctgccatggagagagagaaactcaggaaggacaagtcattcactcaccgacagttactaagaacattgccaaaaagacagcctgggaaccttcattcttagtccagagctcttttcactctaacaagcctgctcccatcgcagcctccttcctgtcctttaaaactagacagatgctgcctcttactccaaagaccaccttccatcaaggaaggagggacacttgcaatactgtgacctccaaccccatgggtttcccatctccgttcttacccaggaagtcctggtcatgtcatggccacataagcttagtggaaaaaaacaccattgatacaactgtcattgtgaaagtatggaggtctggagcctctcataagcctggggttttgggtcatcagggcctatggccaccttacctgggctgagcttttggacaaggtgctgtgccagtctacacccctcagccagctgttcttggaggtcctgcccctgggacttgtccggctcatccggagtgaggagggcctggagatgctcattcaatgagcgggaggcatctctcccttcccgtaacttctcccttaactgggtcagctctcgttcctgagagtgaaccaggactttatattgcctaaggtgagacggtagagaaaatttaagagtggaaagggttgagtgatccgttcaaatattgcaacagagatttctgagacaatgtcctcaaggagacctccaagcagaaggtcagcacatgttgaaaggaatgtctgtggccaagagaaagaatagaaaatggtttacaggcttcctctgtatcagagagggctcctgcaagatcctcgatgatgttccattcatctttccttctgtaaacaaaagtaggtgtcttcctaattccgtttcaaaaagacatcctttcagttcctcactctggccatggacatttccatgtgaaaatacacatagtgcatcttgcggccattagatacaaagccatgtacagaaatgaggccagatgcagatagggcgaattgaaaagacgaaagaagaaaagaatgacagggtcgagaaggcaacattgattgagtgaaagaatgagaagccgcagtcagtcaggaggtgattctcactagggtaagtggggtggtgatggcacaccattttgagtatactgaatgctgctgtgtggttcacactcctttggttaattttgtgttatgtaaatttcacatcaacaattacttgtttgaaaaagagaaaacaaggctctgagaaacaactgcaacccataaatttttattatccttcttctctgtttgataaatatttgtgtgtagcaaacctgccatggcaattcctgcccttcccctggcccagcttagctcttacgtctccccactgagctactgtacttcagagatttacacacctgcccccctgcctgcccccatggggtcccctcacctgagctcctcagcttgcttcagctgctctgcaagcttctcctccttgaactgtcgctcattcctcagcatagattttatgaggtctttgcactcttcatattctgagaaaagacagacacgcctgcatcagtggaaggctggacatgctgctgtggtcattgcctacagggcaggagccaggtccatcccaaggacaaaactctccacagtaccagggtctagacagggatttccacgtctttactcttcagtctcctgactttctggcatctgatcctccaaaatttagagatgaagaaagagaaactcaagggcacatcaaggaagttgacaagatgattcaaccacaacgaagtggagtcagaattcacagtccctgaggtctgactctgaattcggggccactttcccaagacttgcagcctctcctctaaaacactgcactggggcatgaagtagtgatttcttgtacagtcgggaaggcccctaggactatgggactgatggtttcccttttactgggaatttcaaggacaagtatgtgaaagattttaaaaatctttgattttttaatcatatcttcagttatgattttaagaatcatatctgaagcataaagtgtgacacataacaccataaggccatgaaggaaatcctatgcccaaatgctaatgaagtttctgttaatttagaaacagcagaatgaagaactaatagatagtgtttactctgtgccaataaacgttctaggagattgacaagaaatagctcatgtaattcactgcagcaatttacagaggtaggtattattgtagtaccctctgaacaggtgaggaaactgagggacagagaagacaagcaccttggatggagcccaggagacaggcccacggtccctgctctgtacactgcactgctacctccacacattctcgggtgcgatctttcttcctctttaggaacaagactctgtgccccaggaagcaggacttcactctcaccaagctactctctgctttttattcttatttttatttatcattattatttttttttaacagtcttgccctgtcacccaggctggagtgcaacggcaaaatcttggctcactgcaacctcagcctcctgggttcaaaggattctactgcctcagcctcctgagcaggggtgattacagtcacctgccaccacgcccatctactttttgtatttttagtggagatggggtttctccatgttgcccaggctggtctcaaactcctgacctcgtgctctacccgcctcagcctcccaaagggctgggattacaggagtgagccaccatgcacggcccctactccctgctcttgatgctgtcacttatagatagcacaggttctattaggagcagactcctcttgaagcccctcagagcgggtactggctactatcaccaagtttccctcagagtcactagaacagagctttgtgtattgggcctcaacagaaacttgaactgaataaaagttcactagtctcagatatttagaacaacagactagatgttatttgtctgcaggatcttatgtggtacagagaggattcttgaaaacacgattgagcctcttggagaaaacaggtcattctgtgcctgtgtcagaaatcaataaatggcagtttaactctagtcccacccccacctgattgcaaacatggaaagttgctaaatactttggtacctctgtcttccaactttaacaaaatgttaaaatacccatttctgttttcctagaagtatggggaggatgacattatttttgatggagagagcacttagtttctcagagagaagacaggacttcgttcatcactttcgtgatggtgagcatatagatcttactgtatttgttctgctgcttggccaggaagcaggccacttgagttacaaaacatttctctttgaggcttctgaactgctgtttcttctctgccagctgggggcacaatttctcattgatttctagaatgttcatctctgccttctcgctggacaaagggccggctgataccaccatgctgacgtttgtggcagaagaggtggggccagggactggggagaagaaaggcaaacatatgatgggttaaaaactggtgaaatcaaataggcttaatcaggactgagggatgtcactggtagccttgtttacttatttgaagatgttgtttccctggtttcactcttgtcatctccagtcttgatctcctttaagtcaacttgtcttagctatgcagtcaccttgaaaccaagacataaacacttctacacttgcttatacgtttctataaagcaaggcttggccctgagatttttatcccatgagtggccaatgtttctgtgtagcacaaaagatttcattttgctttttaaattttttccttttttggttttttgttttctgtttgagacggagtctcactctgtcgcgcaggctgcagtgcagaggcacaatctcagctcactgccacctctgcctcccgggttcaagcgattctcatcactcagcctgccaagcatctgggattacaagcgccaagtaacatgacagctaatttttgtatttttagtagagatggggtttcgccatcttggacaggctggtttcgaactcctgagctcaggtgttccgcccaccttggcctctcaaagtgctgggattaagatgtgagccagcgtccctggtcagagactttttttttttttttttgagatgcagtctcgctctgtctcccaggctggagtgcagtgccacagtctcggctcactgcaagatccggttcctgggttcatgccattctcctgcctcagcctcctgagtagctgggactacaggcgcccaccaccgcgcccagctaatttcttttttttttgtatttttagtaaagacggggtttcaccgtgttagccaggatggtctcaatctcctgacctcgtgatccacccgcctcggcctcccaaagtgctcggattacaggtgtgacccactgcgcccagccaagacttattaatagctaagacaagccaatgaaaaggagagagagtctagcctgacagaagtgaatgagggtgggaggatcatctcagcccatcctcccacctaagtctcctgagcagttgggactataggcgggcagcaccatgcctgcctaattttttgtattcttcgtaaagatgggtttcaccatatactccaggctggtcttcaactcctgaactcaagtcatcctcccacttgggccttccaaagtgctgtgattatatgtgtgagtcacagcacctagctccatcctagtttctgactaaaacaataacaatatgtgtatatacagcctgtcctcagaattgatcttccatagcctagacagaggtatgagacacaaggaaaatagaggctacctgggagaatgtttagagcatcctgacatccatcatgagaggattctctgtctacaaccagagatgagttgactttgtcttcctcaaatgtgattttgatgttcttgtgaggctggatggagtcacaagggccgtggctatttgaacaagtgatggcacattcctccagtgagtcctcagggactttgctctcttcagccttctgcacctccctgatgagccaggtgggacagagatgacagaagattaaacacagagggattggaccccaaggagtcctagctggttttgacaagcggcattaagagagtggtcccagaaaacaaatggaggttccctttaagagggaacaggcaatcctcttctctctgcaacagagcttcgctgccatgggagccagagaggaagagagcagctggtgttcagtgcactggacagataggagctgaagaggatgaagactcagctatccctgtatggtacagacatgacacttggcacacatagagaaacacaacagctgccgcaccctgtgtctaagctgggttgaatttcacatactgtggccaagggaatgcgggcttttggcccatcatagatgccagagagggcgtgcctcctagacattttcatatgttaccacccattacttgctcctgagtattcaatgttacctgggggcagatgattccagtactttctcatcctcctcaacttgaacatcttcatcctcatcttcgtcattttctataaatacaaaatgttcgttcagatatttcccacttcacattctgcaagcacagtcagcccaacgtgcacagagacatgaatatctatgtatggttcagcattgtactgaaaactctcatgttttatccttcacaaaatgccctggcatggtttcctggtccatcaggcaatgcatttctgatgtggagggccaccatcaagatgtggccaaatactgaaaagaccttttgcttcccatatcactggaggcttgtgcagcctctctctggactttggcagctgtctcccccatcctgccacagatctgattcccaggaacaggcttggtgtcctgtcacagttcgcatttcaaacctcattcattctcttaggagaggacaaacttgtcccacagtcctctatgcgtcatgagactgcacaggccctccatgtggcttctgctgtgttattcagggacattctatccatggggagtgctccagtctgaagcacttcctaccaccaaatgcccccacatcaagtgccttctccaacaccacacggagaggggcttcatctcattttgaaaagcattcgtaagtgttcccatatttggatgcttcagacccttgcaagagacaatttgtctgcctttgcagatggagagagagaaactctggaaagataaatcactcactcaccgacacttactaagaacattgccaaaaagacagcctgggaaccttcattcttagcccagagctcttttcactccaacaagcgccctcccatcacagcctccttcctgtcctttaaaactagatagatgctgcctcttgctccaaagaccaccttccatcaaggaaggagggacacttgcaatactgtgacctccaaaccgatgggtttcccatttctgttcttactcaggaagtcctgatcatgtcatggccacatatgtgtagtagaaaaaaaccccactgatacaactgtcattgtgaaagtatggaggtctggagcctctcataagcctggggttttgggtcatcagggcctatggccaccttacctgggctgagcttttggacaaggtgctgtgccagtctacacccctcagccagctgttcttggaggtcctgcccctgggacttgtccggctcatccggagtgaggagggcctggagatgctcattcaatgagcgggaggcatctctcccttcccgtaacttctcccttaactgggtcagctctcgttcctgagagtgaaccaggactttatattgcctaaggtgagacggtagagaaaatttaacagtgaaaagcattgagtgatccgttcaaatattgcaacagagatttctgagacaatgttctcaaggagaccttcaagcagaaggtcagcacatgttgaaaggaatgtctgtggccaagagaaagaacagaaaatggtctacaggctttccctctatcagagagggctcctgcaagatcctcgatgatgttccattcatctttcccttctgtaaataaaagtaggtgtcttcctaattccgtttcaaaaagacatcctttcagttcctcactctggccatggacatttccatgtgaaaatacacatagtgcatcttgcggccactagatacaaagccatgtacagaaatgaggccaggtgcagatggggcgaattgaaaagacgaaagaagaaaagaatgacagggtcgagaaggcaacattgattgagtgaaagaatgagaagacgcagtcagtcaggaggtgattctcactaagggtaagtggggtggcaatagcacaccattttgattatactgaatgctgctgggtggttcccactcctttggtgaattttgtgttatgtaagtttcacctcaacaattacttgtttgaaaaagagaaaacaaggctctaagaaacaactgcaacacagaacttattattatccttgttctctgataaatatttgtgtgtcatgagcctgccatggcaatttctgcccttcccctggcccagcttcgttcttacttctccccgccgagctgctgtacttcagagatctacacacctacctgcctgtctccccctacggggtcccctcacctgagctcctcagcttgcttgagctgctctgcaagcttctcctccttgaactgtcgctcattcctcagcataaattttatgaggtctttacactcttcatactctgagaaaagacagacacgcctgcctcagtggaaggctggacatgctgctgtggtcactgcctacagggcaggagccaggtccatcccaaggacaaaactctccccagtaccagggtctagacagggatttccacatctttactcttcagtcttctgactttctggcatctgatcctccaaaatttaaagacgaagaaagagaaactcaagggcgcatcaaggaagttgacaagatgattcaaccacaacgaagtggagtcagaactcacagcccctgaggtctgactctgaatgcggggccactttcccaagccttgcagcctctcctctaaaacactgcactggggcatgaagtagtgatttcttgtacagtcaggaaggcccctaggactatgggactgatggtttcccttttactgggtatttcaaggacaaatatgtcaagaactttaaaaatatttcatttttaaatcaatattcagatatggttttaagaatcatatctgaagcctaaagtgtgagacataagacaataaggccatgaagaaaatatgcccaaatactttattagtatgagaggcagcattaagatttagattagttgtgttaatttagaaacagcataagattagtttgtgttaatttagaaacatcagaatgaagaactaatagatagtgtttacactgtgccaattaatgttcaaggagatcgacaggaaatacctcatgtaattcattgcagcaatttacagaggtaggcattattgtagtaccctctgaacagatgaggaaactgagggacagacaagacaagcaacatggatggagcccaggagacaggctgagggtccctgctttgcacactgcactgctgcttccacacgttctcgggtgtgatctttcttcctctttaggaacaagagcctgtgcaccaggaagcagacttcactctcaccaaggtactctctgctttttatttttatttttgatttatttatctttttgtttgtttgttttttgacgagtcttgccctgtcacccatgctggagtgcaatagtgcaatcttgactcactgcaacatctgcctgctgggttcaaaggattctcctgcctcagcctcccgattagtggtgattacagttgcccgccacgacgcccatctactttttgtatttttagtggagacggggtttctccatgttgcccaggctagtctcaaactgctgacctcgtcctctgcccgcctcagcctcccaaagtgctgagattacaggagtgagccacgttgcacggcccctactccctgctcttgatgctgtcacttatagatagcacaggttctattaggagcagactcctcttgaagcccctcagagcaggtactgggtactatcaccaagttcccctcagagtcactagaacagagctttgcctgttgggcctcaacagaaacttgaactgaataaaagttcactagtcctagacatttagaacaacagactagatgttatttgtctgcaggatcttatatggtacagagaggattcttgaaaacatgattgagcctcttggagaaaacaggtcgttctgtgcctgtgttagaaatcaataactgtgagtttaactctagtcccacccccatctgattgcaaacatggaaagttgctaaatactttggtacctctgtcttccaactttaacaaaatgttaaaatacccatttctgttttcctagaagtacaggaaggatgaaattatttttgatggagagagcatttagtgtctcacattcatcactttcatgatggtgagcctatagatcttactgtatttcttgtgtcggttggccaggaagccggccagttgagttagaaaacatctctctttgaggtttctgaactgctgtttgttctctgccaactgggggcgcaatttctcgttgatttctagaatgttcatctctgccttctcgctggaccaagggccggctgataccaccatgctgacgtttgtggcagaagaggtggagtcagggactggggagaagaaacccaaacatatgatgggttaaaaactggtgaaatcaaataggtttaatcaggactgagggatgtcagtaactgaaattcttaacttactgttgtgaaaaatgtgatcactccccacagcactttaggatccttcaccacaaaaacaaggttcgaggtgcctcaactcagagctgaaagcactgctcagactctgataagagtgaggtagattgtggccagcgtgccaggtaaccgtctgcagttgcaataacagaattagaaggtaggggtgtcatggaatcttaggagccctgcattccaattgcccaggctttgctgaaacacaggcaccctagtctcacctgagggtcaccaccaatggggatcattccttcagcattcactctcagtattcgtgtacccttgtgacaatgccacagacccgtgtctttcccaatacatctaagcatattcctcactgtttatctcttgtctgtacaacatcatcaaggcagaaacagtttcccaacaggttatattttcttaatggtagtcatgaagtcataaataaaaaaatggaatcatttagtatgttctcttgttttgacttttttttttttttttttttgagacagagtctcactctgtcgcccaggctggagtgcagtgacgcgatctaggctcactgcaagctctgcctcccaggttcacgctattctcctgcctcagactcccaagtagctgggaatacaggcgcccgccaccacgcccggctaatttttcttttttttttttttgtatttttagtagagacggggtttcactgtgttagccaggatggtctcgatctcctgacctcgtgatctgccgcctcggcctcccaaagtgctgggattacaggcgtgagccaccgcacacggccgacttctctttactcaggtgggtatatatgccactaatttgtttgattgtgtttttcccttgtttcattttgttttggccaagtaatatcctattgattgtatgattatcacacaattttatatccatttttctgatgggagacaggtttacttgataactactgtgcataagtaactatgaatattctcatacaattatttctgtgaagatacatacttattttcctgggtatctatagctagggatggagttgcttggtgaatgggtagaaaatgttggacagagttttgcaaagtatttgtattgttttacatttctatgaaagatgtaggccatttccagttgctctacattcccacacacttaatattttcagtcttttaaactatgccaggtgtgtagtgatatcctaaaatttggttttctcatgcctaatgttcatttagatatcttcttatggaaaatatcttctcaaatttttatattcattgatatactgggctgtttgtcaatttctttgtaataggagttctttatatattttgaatgagtccatttatacatacatattttttgctgtattatatagcaaataattattcctggtctagagatagcgtttaagttgttaaacaacaacataataaggagaagctttttaaaaatgaagtgcaattcgcttgatttcttattgtggtgagtgctacagtatctagtctaagaaatattttcctgtgtcaagttcatgaaactatttcctatttttcctttacaaggtttctaattttaactttcacatcttaagttaatttcaatatatgatggagagtggttaatattaactttttaaaacaacaaatattatttcactcaaaatcgttttacttaaaagtctttcatttccccaatgaagggcattggtgtctttgtttttaaaacatttagaagcggcggtgcgagcatgttctcactcatgggtgggaattgaacaatgagaacacttggacacagggcggggaacatcacacaccagggcctgtcatggggtgagggctgggggagggatagcattaggatatatacctggtgtaaatgacgagttaatgggtgcagcaaaccaacatggcacacgtgtatatatatatataatatatatacacgtgtatatgtattatttatatatacacatgtatatatattatatatatatacacatatatacatgtatacacgtatatataaaatatatatacacacacgaatatatattatatatacgtgtatatacatacgtgtatatatataatacgtgtatatacataatatacaatatatataacacgtgtatatatatattatatatatattttttcttttttaagtggcggagcgagggctactgcacagctagcagagtcgtggcgaggaggacagcacctgcatcgagctctccgcctcccccacccgccagcccaggcggccccagcagcagcgaccagaggagcccctgcagcaacgcaaaggccaggtggacacctccatctacagcctcgtggcggacgggacctgttaggacacggccattgtgggcaacaaggacccaccttccatctgtgccaccgtcccagggaaaaccttcctcaacatcacgccagctgaggttggtgtcctggttggcaaagactggtcaagctttgtcatgaatgggctgacactggggggccagaaatatactgtggtcctggactcactgctgcaggatggggaattgaccacggatctttgtatgaagagcatcggtggagcccccaccttcaacgtcattgtcaccatgactgccaagacgctaggcctgctgatgggcaaagaaggtatccatggcaatttcatcaacaagtaatgttatgaaatggcctcccaccttcagcgttcccagtactgacctcctttgttccttccactccaccgctccccacagctttgcccgcctttccttcacatacacacaccattttaatttcaggagtcattaccccacacaccttattgctgccaaaaccacatgggctgggggccagggatagatggacagacaccttcccccacccatacccctcctgtgtgtggctggaaaacttttttgttttgatggattttttatgaataaaaaagattctactaaaaaaaatcaataactgtacatatgtgggcatattgtttgaatctgtattcttttgctttgatatatttatgaatacttacaccattactactgtttttaaattactgtagctttaaaatcaggtttgaaatctagcagagcaagtcctccaacttattgcttcttcaagaccgacttgcttattctaggttctttgattttcaaatacattttgaaactagctttcaaatttctctaaaatctcctactagaaatattaatcagaattgtgttgatgtaatatgctaacaaaattgagtcttccaatcaatgaacatgatatatatttatttagccttctttaatttttctcaccaattgcttttaggggcctcgtacctgcttcattgcatgtattgttaagcatgtaatgattctggctattaatctctattatgttttattgaatttcattttctagctgctaattgctagtatggagaaattaagatgatgaaatcaactttataaaggcataatttcggtacaacagactgcaccactttaaaatgtgtaattcaatgcacgtttacaaatggatgcactaacggaactactgccacaaccaagatagaggaaattccctatgcccaaaagtttcttgtacccctttgcagttcatcagcctttcaaccctcagccccaaggagccactgtcacttcaggtccgtttgcatttttaaccattttctataaatgaaatgatacctgtgttcttttgtgtctgccttctttcatgcatcaatgtaattttaaaatccatctgtaatgtcttgtaaatactgagtagtattccttcatgtggctataccatgtatgtttgtactttcacttattattggacatttctatcattccacgtttgggctattatgaagaaactatcatgagcatccatacgtagcaggccaggtctcactaacacaggcctccctaaaaactgtttcagtagcgactgagtggttcaattaaatattaagaggaaaaaaaaaaaaaaaagaagccagtgcccttatacaaaggctggaatgtaacaaaagcccaccaagagttttgcctaggtttttcctgggccttaaagcatgacgaaataacgaaggcattcttaacaggagccatttagtattaaacgagttttactgggggtctgaagaaactccccaggcctccacagacaagtttattggagatctgaagggactctccaaacctctgtgatttagcaggagacaagataagggcccccagcacctagacccatttagattaagtgaatttaactgaggttccagaggaaggtctttaggactcagacttagttatagattaaaagaagttaatcacttatgtatttagatgaatgcacacttccacatacacatatagcttagaaggtacattagctcaggaaaactttccaattttgagttggtctggtgataatttccaggccgtttccctgtaaccagttgcagaagtcaaaactctcttcctccccagttcatctgtgtctcgttactgagccacgagaaatagcagcccgcccctcaggttggtctggaaacacacatacagatcattgtgcagacacagtgtgtaaattcctaggaatggaatgactgtctatctgatttgtgttatgtttaacctttaagaaactgttagattttcaaaggagcaataccatttttcattcctacaagtataagacttccaagtgctttatatcctcaccaacatgtgctattttcagcctttttaattttagccattcttatggatatgtactggtatctcattgttgcactgattgatctccctgatgactaaacagtggagcatcttttcctatgctaattgaccattcatgtatcttcttttctgaagtatctattcaagtcttttgagaaattgtttcattgtgctgtttatcttatcagactgcaatatatatatgtgtgtgtgtgtatatatatatatatatattccctatttggagatgataatcttcaaaacggtgaatatatatatatatatacacacacacacacacacacatgtttgtgtgtgtgtgtgtgggggtgtgtatacatatatatatgtcctaagaatcaattagacatacatgtgagtatctatttctggattctctcttctcttccactgatatatattctatttttttttttcaacaaaacacataatcttgattttcatagctgtagagtaattctggaaataggtagtgaattcattcaccattattcttttataatattgctattttattattcttgatcattgacattaccatataaatggtagaatcagcttgaaaatttctaccaaaatgccacttggaatttttattagaattgcattggatctggagatcaatttacgaagaactgactctttaaacataacaactcttctgatccatgacaaggtttatctccccactaatttagttctttcataatttctcaaagcaattttttgtagtttttggtgtactggccttacataaattttgttgactttccttttttttttttttttttttttttttttttttttttttttttgagacagagtcttgctctgttacccaggctggagtgcagtgatgcgatctcggctcactgtaacctctgcctcccaggttcaagtgatcctcctgcctcagcctcccaagtagctggactacaggcacatgccaccacgcctagctaattttttgtatttttagtagagatggggtttcactgtgttaggcatgatggtctccatctcctgacctcatgatctgcccacctcggcttcccaaagtgctgagattacaagtgtgagccatggtgcccagtctgttgaatttatttataagcacaacatgtatttagatgttactttaaatgaaattgtattcttatttcattttccaaatgctcattgctaatatacagaaatacaaaagaccacttacattgagagcttacattctgcaacactaccaaactcactgattagttctggtagatttttgtagatttctagcattgttaacaaacacagtcattatctgtgaataaagacagcttcaattctttcttttcaatactttattaatttttcttactttattgcattgacttagagctctagtataatgctgaattaaaagagtaacagcaggtattctacttttttctctgatttaatagaaaagcattcaatcttatgccatttaatataatgttacctgtgggttcttcaaatctgcccttaatggggttggaagtgttgccttctgttctcatcatgctgagcattttctggggtttgtttttataaatcatgaaaaaagttttcaattttgccaaatgcttttactgtgtatgaccacgtaatcatacgagttttctcttttgccctggtaatatataaaatgatattttttaaatataaaaaagaggccgggcatggtggctcacgcctgtaatcccagcactttgggaggctgaggcgggcggatcacacttgtggcagcattgaaggcttcactcttccccaagggatccaatctccccccagtcaagaagctccaggtatctgaactggataccaggtcataaatttccactatggtgactccaacaggtctctgtcctcagaactagagcttttctaattattacataagttgacttcttagtagatttcccatccattacatcccagacacctcacaatgattagtaaccaccacatgtccctgcctctcaaggaaatccctcccgccttgtctctagacagccaagtcccacggcctgtcctctactcttccagaaccctgttgttctgacagcagggagggcaaatccatgcagcatctcccgccatgacctccagcctgtagaggagaggcgccacaggacctttacatgcacgccgctgttcccctcacccatgcatttcttaatgccttggtgaggagaatgcctctgggtcttccttggtgggagctaaaggaacaaaggtaaataatgctatgggacccactgagaattggggctgtggaagagtggccactgaagtaatagacagatgcagctattgtcagatactcagtgccagagcagggagggagagggaagaaatacggacctcaccttcctctcacttccaggctccatcgggtgcccacattgctaaacctaactagaagtgtgcacacaggggagccagggatgcattctagaagggacaagccccaagtggcgtaagacaggatggaaatgagtggaaagtggatctgtgggaaggaggaggggatgttatggggaaacaaaaggagaatactagctaataacgctaggtgacactaatatccccaagtctgtgctcatattcagaaaagaaagctcagcataaagcactcaaccaggagtcaagatattgttattttcaactgttgttccaacagttgtattataaagggccagtttatttcatgcctttctaatttgacataaagtgctacatggcattggggctggtacagcctcactcaattatgtgttgaagagtacacagagactgccaggctgagggacgatgcaagagaatagaagagatgctcacagacaaccacagaccacacggccctagagtcaggggcagcaccagccactgtcggctgctcatttgtccagacagagcccacaagcctcaaccatgctttgcttctgcaagatgcttcttcaccttttcaataaacctgcctgaattaaagctgatgggagtttatttctccttcatcataaaagaaattcttcaccacaacaatctccaatgaattgtgggcacagaaggcagacccatccctgcttctcttccactatctcccctgtaggctgaaaaggaggaggtactgaattacctccaaatgttcctctggctctgatattctgtgactctggtttctttttggctactttgtttttggaagcatgtatcctaaggcatcctgttgaaaaacctttgtctactgtgtccagacattcctggtggtatttcagataagacactcttgggttgctgcactcacaagcactgaaacaattctatgaccatctgtttcatggccacctgtttgctcattttctatgtacataaagggaggggacagacagcaaatttgcatattataaattgtatcatcttaaaaaggaaacaaggcaatattttgcaataaaaccttaagatgcattaaatttaagcctaatgcaataaagaatgcccataaaattattatctaaagaatgtttagaaaattgttgaacaagggacatcatcatttaaagtgatatgaagaaaactcagctaagcatatgggctagattagagagaaaaataaaggacacatctctgccctggaaaaactactggtagcatctttcagaaagctctctgtgtttgagtacgcaccttgatccataggctcacatttgatcccaactggcagctgcttcttggcattaactttggattcccaaccagtaaatcttagcaagatctgagtttctccaggtatgatattattttgtttgaccatccttatcttcaagggctaccaagaagaaacaaataatttatttacctccccagaggaaaaggttttaccaatgagacactttcttaccatgaccctgttcacttgagtgccctgtgtggcctgagagaagctcatactggtcacaggattctttacatgattaaactccttcctgaatcccaacttcatggtggtggtgatgacaggtatcccatgctcatgtccctgaagtcatcagcctgtctccagttagaaaaaattacatgtatatagagaggcctctttggaagtagcgaaagctttctcaccttcatacattaatggttggaatgtacaatagtataaacactttgggaaaaaacgtctggcatattcttacagaactaaacaactacctattctatgactcagtaattcctaagcatttatccaagagaaattaaaacatatgtgcagaaaatgatatatacaagaatgtccatagcagttttattcgtaataggaaaaactggaaacattcaaatatctatcaatacaagaatggatacattcttgtattcaaatatctatcaatatacattcaaatatctatcaatacaagaatgtgatacattcattccatggaatggctaaaggaacaaacttttgacacacaaaacaacatggatgaatctcaaaaacattttgagtgcaataggagccatacgcaaaacagtgtgagaaaaatgataaataataatggtttcaagaaatgcagagcagagagcccagaggcaaagacccacaggacagagggtcagtcccaggctgtggatccttactaagaaactcctgcgggattttgcccagctccatttccaaactattttgggttagtgacttctttatcccctccatgttccctcattttgaactagaatcactgtagttgttattctatgcctgtcccatcatttcacattagggacagataagctgtttgttcagtttcacaggtcgacagaggtaagggaattatgtcaaggatctgcacttaatggacactctcggaagcctcattcacacctggtgtggatgttttagatgggattttaagcttttgatctgatgtggtctacatgacatttttcatgttgaactaatgctttaatgacatgaaatctggaaacctcaggggagagggtaaatgcactttgcagatgggggaatgtgagtgtcctactgtggtagatggaatttctgaaatggtccccaaacatgccacacccttgtctctaaagcctcttaaggtgatgagacaccattcctgtgactacattgttatatgccagttatatgactttaagatggtgaggttaccgcatgaactggatctaatcacatcactccatacatgacagagctttgtgtggctggttggagaagatgaagtcagagaaggtgggagcttgagaaggactccataagttgttattggttgaaagatgaaacagacaggtaaggaggaaagcacgtggcctctggagtcagagtagactgtctccccgctgacagccagcacagaaaaagggccctcagtcccccacaaacaagaataggaactctttcattatctgtagtgaacctggaaaaatagcttgagctctaggaaaaaaacacagccagcccattcccggattttagtctcacatgactctgatcagagaacccggccgcttcattccagacttctgtggtttcaaaccactggtttgtggtaatgtgataataggcagcgagagaaaactagtacaggtgcctgtctctcctcttgaatttcaatttcagataaatgtatgctaaccctctaagagaaaaaaatcaatcaatcgaccaatcaatgaaagaactacagtaaaaatattgccctcacctttatgtggctgttccagagcccttgccacctgaagaagacaatgaggggtatttcaggcacttgaggagtgtggctttactgttatcaatcacatttctgaaagaataaaaatggttcagtgaagggatgggttgcccctccacacctgtgggcgtttctcgttaggtggaaggagagacttggaaaagaaagagacacagagacaaagtacagagaaagaaaaatgggcccaggggactggcgttcagcatacggaggacccatgcctgcactggcctctgagttcccttagtatttattgatcattattgggcgtttccggagagggggatgtggcaggacaataggataatagtggagagaagatcagcaggtaaacacgtgaacaaatgtctctgcatcataaacaaggtaaagaaaaaagtgctgtgcttttgatgtgcatatacataaacatctcaatgccttaaagagcagtattgctgccagcatgtcccacctccagtcctaaggcggttttctcctatctcagtagatggaatatacaatcgggctttacaccgagacattccattgcccagggatgagcaggagacagatgccttcctcttatctcaactgcaaagaggccttccttcctcttttactaatcctcctcagcacagaccctttacgggtgtcgggctgggggacagtcaggtctttcccttcccatgaggctgtatttcagactatgacatggggagaaaccttggacaatacctggctttcctaggcagaggtccctgcagtcttccgcagtgtagtgtgtctctgggtacttgagattagggagtggtgatgactcttaacaagcatgctgccttcaagcatttgtttaacaaagcacaccctgaacagcccttaatccatttaaccctgagttgacacagcccatgtcttagggagcacagggttgggggtagggttacagattaacagcgtctcaaggcaaaagaatttttcttagtacagaacaaaatggagtctcttatgtctacttcttcctacacagacacagtaacaatctgatctctctttcttttccccacagttcaggtcaggccatggctcatatctgtaatcctagcactttgagaggccaaggcaggtggatcacttgaggtcaagagttagagaccaacctggccaacatgaagaaaccctgtctctaccaaaaatacaaacattagccaggtgtggtggcaggcgcctgtaatcccagctattcaggaggctgaggcaggagaatcacttgaactcaggaggtggaggttgcagtgagctgagatggcgccgttgcattcgagcccaaggaaaagagaaataactccatctccaaaaaaaaagataaaataaaataaagacggttcactacttaactccaaatattattatgtgaaaatgtatcatctcaattttaataggagattttaaaaaattccttttcttgtgctcaccagacaaggtttggtaacaaataccagtcaccagcacagaagaaccaattcaaggagagccataaacaggactactattatgttcccccgaaaaccatccctagaatgcaatctcttctctatttgtcacaaaacgaacacaatagtccactacataaagtcccaaacacaggaaaatgtaaatataatgaaatctgctttccaaatgtttattctattcagacccagtcatggggaccagggattaggaaatgactacaaacaggttcaagggaatttgggaagtgacaaaatatgctgaagtagaactctgctgatggctgcacaattcgataaatcaacttacatcattgagttgtacattaacaatgggggacttttataacaagtaattctttaaacaaacttttgggtttctatttcaacatggaaagagctaggcagtcatcacttgtcctcacagctagaaaaaagctgaacaaactgaaagtcaacccttctagggtggatcagagaattgaggtcacagggaaaactgccaccttaaaaatgagaaacacaggctaacacataaggagtcacaggtcacagggaagagaagctactggggacagcaagtgggaggagcacttaaatgatattgacaggttactagaagctgagggtagcctggctagaacattaaaaactccttgaagaccagactaagggggaatcttacacatttccaagttttactacaatgatctcaaccaggttctcatgatgaagttcagaaaaactccctgaggtttggcactaccaacttcaggacttacattaagctacagtaacccaaatagtgtgaagttggtcaaaagagaaaacacacacaaatagatgcatggaaaagaatacggagcccagaagcaggcctacatacagtccactgatcttccatggaggtttagagacaatttaaaacagcaaagatagcctttccaactagtggtgctagaacagctggacaaccacatgcaaagaactaaataaatccaggtatgcatgttatatcctttataaaataaatcttacacgtaaatgtaagcgcaaaaccataagaatcctaggagataacataggagaaaatctcggggatcctgggttcaatgatggcttcttaaatacaaaaccaaaagcacaatctactaatgaaaaaaaattaagttgagcctcattaaaattaaaaacttctgttctgtgaaagacactgttaagagaatggaaaaagcaagtcacagactgggagaaaatacttacaaaataatctgatggaaaaactgctgtccaaaatatatgaagaattctgagaactaaacaacacaaagcaaaaaaaaaaaaggtgaaagatctgaacacctcattaataagatatacagatggcaaataagcatatgagaaagatgctcaaaatcatttgtgagggaattgcacattaaaacaacgagatatcaccataaacctatcagaatggctaaaacacaaaacggtgaacacaccaaatgctgtcaaagatcaggaacaaccagaactctccatagctagtggaaatcaaaagtgtagtcactttggaaaacttaagttcattcaaaatcctgcacgtaagtacttacagcaattttatcataattgtcaaaacttggaagtacccaagacgtctttcaccaagtgaatgaataaacaaactgtgttgtagccatacaatgaaatctgattcagggattttacaaaacaagctatcaagtcatgaaaaggcgtggaggaacttaaactacataatgctagaaagaagccagtctggaaacctacatactgtaattccaactctaggacattcttggaaagtcaaaaagatagaagtagtaaaacgatgagtggttgtcaggggtggaggagaggaggaggcatgaaatggtgaagcacagggaattttcagcagtgaaactattttgcatgatgctgtattgaggatttaggacattacgtaattgccaaaacccataatctgtgaaactcaaagaatgaactctaatgtaaactatggactttagttgataatgatgtatcaacagtggttcatcaattgtaacgaatggaccacactaatacaacatactaataggggaaattgtgtgctggaggacaggggagcctaggagaactctctgtactatctactccatttttctgtaaacctagaactgttctaaaaaataacatctattacttttttttaattaggatgcagcagccccataccaaggttttggtggcatcctgttattgtttggttagtacttggcattgaagtgcaccaacctggagtcagagcagttggagatttcaatgcctatgccatttacctctaaccctggggtgcccccggaacacagctagcagatcagttaggcagaagcagcctcagtcatctagacagttcagggttctggtaaggacaggtgcaaaccatctaggtgggcagaacttggtgatgactaggaaccactgagactcagcagctgccccagtggcacccacaaatcagaggaggaggaggctgggaggacctaagggctacaggatgagctccctgcccacaagacagaagcagctccagagattttgataagcaatgtagatttcagtgcagtgtggtctatttaaaatagtagaacaaaaaggaaagaaaaagagagagcatgagagagagagaaagaaaaagaagaaaggaaagaatggagggagggagggaaggagggagggaggaaggaaggaagggagggaggaaggaaggcagggagggagggaggaagggaggaagaaaggaagggagggaaggcagaagggaaggagggagggaaagaataaagagagagagaaagagagtgggagggaagtagggaagggagagaagtagggaagaaaggaaggaaggaaatgaacaaatttacatgaagatgagaacatccaggggaacttacaccaccagtatttccattaacaggaacatgctaactagttattagagagagacgcactactgtaaaactatatactgtttccatggggtacaaccccttcttcctcctctgaaacacattattcctctggcccgctgttgccagagacactgagtcttgtctttggataagttctggtgccccaaagaatgagatgagacagtggatcccagaacaccaggccgcaaccttccctgctgctccttgtccactccagaagctgcccggctgcaggtgggggcctcagcccctgggtctgacatcgtccatttgtcattctcactggacttccctccttgcactggctcccactcccccaggacctggtgggcagccacgtgagaaggatacaaacaggccatgcccctttctttctccccctctcaatgcctgcagtggtgggttccgtggggtagtgacctgagatttactcattatggggcctctagcccagagcagggcatggtacctaatagtcaccccatgaatggtcagtgaaagaaggcgtccaccacaaggtcctggggaaccaagaattccactgtggcccataaattctaagtcctacaggattctggaatgggagatgggatcggccttcaaaagtggtctctcttttaacccattatactggcaactgagccatgtttccccatcctggacacatctagagggcactgcctaaaaccacacacatctccccacccaggacagtgcagagccttagcctgggggatgcgggtggacagggagggggtgagccatgaaagctgaagaggagaaagcaggtgaaagaggacagcagggtggaaacagagagagaaatgggggcagagaatggggggtgagaggggaagagagaggagagggatgcagatctagctaccaaggaaaagtcctgaagagaacatgtcctctcctgaagtaaaatcactttcacccgaccatggcactgcaagtccagggcggcacacgctgtgaatatttgttcattcatttaacatatatttatttaatatctgtttgatgccaggcaaggccctgtgatgtttagggcccttggcatcttcccttcacatctgagtcataatagaaagaggactctctgaccccatcgagctggcaatgcctcaggatttttacctgttggatctggcagctcttcatgtcggcccacaccatgtgaagctgctcttggtgcactgaatgggtaagtttctacatcggtgcctcggagagtccaccagaagccctggacagtgggagttggtggcacccccagtgtggaggccaagagcacacagcactgaagctccagacatcctcaggagaatgataagggacaatctgctcatgagagcctgggtcaccaggaacctttgcctgggtctaaacaggatttgccttcagaatgcctatgagataaaagagagaaatcaaggttaacattgagatttggggcttgggcaacttgaagggtgaagctgccatttaccgagactgggaagacccaggcaggagcagattgaaaggtggtggggaactagagttggttgggtttctgtcatatgtaatcaacagtcctcaccagcctgtgcaacatagtaagaccccatctctgaaaataaaaaatgagaaattagccgagcatggtggcgcacacttgcactctcagctactcgggaggctgaggcaggaggattccttgagccttgagttagaggttagtgagctatgatggcaccactgcactccagcctggggggaaaaaaatagagttctgactaaatatttgagtagccagggaagttttcacaaagtaaggaatatttgaggtagatcttagtgaacaagaattcgattctttctgttagggaattaagagtgtgtgggcgtagttaatgcttctttggaatctcatctactggtctatctggtctatctgtacccgtatattctacaggctgtctcactgagctttcactaggttatgctgcagtaacaaaagccccaaaatcttagcagctacacatacaaaggtttatttttcattggcatttccttttatggcagcttgactatgattctgctctatacaagctattttatttgttagatggtgaaaaccgtgacacttggagattgctgaatatggtattagtatgttcattcattcattcatttaacaaatatttattcaatatctgtttcatgccaggcgaggtcaagtactgagaatacagtggtgaataaaagaaacaaaatctctaatttccaggagcttatattgaaaatgagattgaacacatacaaaaaaaaataataacaataatgaatactatatttacaaataatagctgtaagagattttagtacctgttttaaattagaaaaatataaaaattattaaaactaaaatggccagatgtgatggctcacacctgtaatcccaacactttgggatgccaaggtgtgacaatcaactgagcccaagtgtttgaaactagtctgggcaccacaggaagaccctgtctacaaaaaataaaaaattagctgggcatggtggtgcatgccgtaatcccagcactttgggaggctgaagcaagcagactacttgagcccaagggtttgagaccaacctgggaaacatgttgaatccccatctctacagaaaatacaaaaattagccaggcatggtggcacacgcctatagtcgcagctactcaggaggctgaggcaggaggattgcttgagccaggaggtggaggtggcagtgagctgagattatgccaacacacttcagcctgggcaacagagtaagaccctgtctgaaaaaaaaaaatgcaaaaactaaaataaaattgctataaggttaatatagaaaagtgtgttcatattcttaggctaggcattgatttcttttttctttctttttttttttttttttttttttggtacaagacagagtcttgctctgtcaaccaggctggagtacagtagtgtaatctcggctcactgcaacctccgcctcctgggttcaagcaattctcctgcctcagcctcctgagtagctgggattacaggtgcccgccaccacatccagctaatttttgtatttttagtagagacggggtttcaccatgttggccaggctggtttcatactcctgacctcgtgatccacctgcctaggcctcccacagtgctgggattacaggcatgagccaccgcacctggccaggcattgatttcttaaacaggacacaataagcagtaaccataaaggaaaagattgataaagtatatttcattaaaattaagatactctggccgggtgcggtagctcatgcctataatcccaacactttgggaggccgaggcaggtgtcacttgagcccaggaattccgtatcgggctatgcaacatggcaaaaccccatgtctagtaaaaatacaaaaaacagctgagcatggtagtggtctcctgtaggtcccagctacttggggactgaggcaggagcatcacctgagccttgggaggtcgaggttgcactaagctgtgattgtaccactgcactccagcctgggcaacagagtgagatcttgtctcaaaaagaaaaaaaattagagaatctccattcatgaaaaaacgtcattaaaagagtgaaaacacaagctgcagattgaaaaaagagaaatgcaatccatatatatcctagaaaggatgcatatccagaataaagtattacaaatcaacagaaaagcatatcaatgaaaactggataaaaagatttaggggcaggggtgcggagggaccgacggacgcacgggcgggcggccgggagccatggagcgcggccctggggcccgggggcgcgggccggggtgggcttcccacggcacgacatggagacctgtggttgcgaggctccctggggctcggcttggaccgcgatggggctgggccctggcctcctaacggggctgctgtctggggcggtagctgggggggcgctctcccccctgcccgcgactcggagcaccccacccctcccctgccgggccaggccgggcggcgttgttggcgggggccccggtggaggcccggcccgggcggcgcccgccatgaacgggctgtcgctgagtgagctctgctgcctcttctgctgccctccctgccccggccgcatcgctgccaagctcgccttcctgccgccggaggccacctactccctggtgcctgagcccgagctggggcctggtggggccggggccgcccccttggggaccctgagagcctcctcgggcgcacccgggcgctggaagctgcacctgacggagcgtgccgacttccagtacagccagcgcgagctggacaccatcgaggtcttccccaccaagagcgcccgcggcaaccgtgtctcctgcatgtatgttcgctgcgtgcctggtgccaggtacacggtcctcttctcgcacggcaatgccgtggacctgggccagatgagcagcttctacattggcctgggctcccgcctccactgcaacatcttcacctacgactcctccggctacggtgccagctcgggcaggccttccgagaggaacctctatgccgacatcgacgccacctggcaggccctgcgcaccaggtgagggcgaccctgggggcagctcagcctgggcacacccaagaggggaccaggcggggggccggggggcgggcttccctgggaggaaggtgggcggccctgcaggaggggagccacagtggatgcacagggccagagagccggacaggcgagcttgggtgtgcaggtgccgcctccacatggctgaggtgtggccaggcggtcctcccacaccctggcctgtggagccaggctccctgggaacccctggcctgaggatgggaaggggctgagcttgtcacaggggtgtggatgccacctggcgggagggagtgggtggtggtctgggggtctgtgcacgtgtggctgggagcccatcggctgaggcagcacttggggccaagtgaggcgaggctgctgcatccaggtccggaggactggcccatgaggccctgtggctgcggagcttggccatcctggggcagggcctacagggtaaggtgcagacccgcagcacacatccgaggtctgggccagcctcgattccagatccagccctcctagtcatccacgtccccagccctgtgcttgcctgggcccttcaccggtgtttgagcagcgcccgggccagtgctgctttggacgaggagacccggctgggcctctggtggcttttcctgctcgccatccactgggcctgtctcgtcctggccctgcccagcccactggtctgacctgctcccgcagggaccaggcacagctctgagaagtcagaggccctagggaggtggggtcgtcgttgccttggtgatatgcaggcagtccctgctgtgggcctgggagctggtcccctggcaccaccctggctccaggggcctcccggcagttgtgggacgctgacaccaatcaccacttcatgcggcttcctcggcccctcctgtctctactgcctgggccactggcagagtcacacctgccatggccagctctgagctctgtctgctcggccatctgtcctgctgcccctttgtcctgcaggaacctaggcccagagccatgagggggaggccagagcgtgcccagggcctccactggggatgtgtcccgttcgtttgagtggtgacatccaggtggcagctgggggctcctgcctgtagcaggtggcagggctgggctggctcagcacactactgaccatggctgccagggagcaggccggggaggccgaggcagagctggggccacaggcaccagccaggcagcatcctttggggcatgggtgagtggcgagctgtggagtgctgccaggaggctgggattccaggccagggacggggacagccctgctggtggagtccgaatgccaggcagaggggacgcacacctgcccatgctcctgccttgcaagagggcgtctgcctgggatcagagcctagagcgtgtgggaggagagttgtggggtcccggcatgggcagggtggcaggtgggtcccgcgtgcttgggactgggcacgaggaggccttgtaactggtgctggatcagctgggtcaggggccgcacaccaatgacctgggggtgagggtgcccctgggtgggagctggtggtgctgaggtggccgaggacttgtccactcccaagggaaggtgctggtgggagggggtgccacctccgcagccaccaccctcgatgctgacctgggttgcactggcatctcactgggcgtggggactccgagagtccaaaattgggtggagacatttggggacacagctgcctgaattcctcatggccaagggggtgggcaagggctgcagggaggaagagtgtccgctgtcctggccagtgcaccaggaacggctttctaacccgggcaggaaggtatgaagcattcaggatgtgggggccacacagttcccagtgtgcacctaggggtgaccaggaggaggagaggcgccagggcctcccttacccccgccccaggggcactccgtaggcaggatccctgcagatcctagctaggaaacgccagtgaacggcagcgcagggaacggggcggggccgctggcttcgcccaccgccacggtgttgggggctgggggtggccctcgggactggtgtggagcctgagcctgacccactgacttggctgagtggggagactggagggtcgcatccggagctgggcccggggacgcccgctggtgggaagggtgcgcgcgcgttggaggccgcggctgaccctgctccggcgccgccaggtacggcatcagcccggacagcatcatcctgtacgggcagagcatcggcacggtgcccaccatggacctggcctcgcgctacgagtgtgccgcggtggtgctgcactcgccgctcacctcgggcatgcgcgtcgccttccgcgacaccaagaagacctactgcttcgacgccttccctaacatcgagaaggtgtccaagatcacgtctcccgtgctcatcatccacggcagggaggacgaggtgatcgacttctcgcacgggctggcgctctacgagcgctgccccaaggcggtggagccgctgtgggtggagggcgccgggcacaacgacatcgagctctacagccagtacctggagcgcctgcgtcgcttcatctcccaggagctgcccagccagcgcgcctagcggcggccccaaccagccggacctcagcaataaggcggcccccggacctcaccccgcgccggcccccacccaggggctgcatgtggacccccccgggcggcccaggggaccccgccccgacccaggggctgtggacgatgtacaggcaacagagctacgcactcctttccttttggaagcaagaagaaaatacgtgaaaacggaaattaaagatttaaaattaaaaaaaaaaaaaagatttaacaggcacttcataaaagaggacatataaatggcaataaaagatactcaatctcaataccaggaaaatggaagttgaaaccgcattgatatattactgcacctctacgagaataacaaaataatttttaactgacaagcatcagcaaggatgtggggtaactggaatattccctgctaactgataaaacactttgggaaaatgttcagccatatgtaatactaaagttttatcattcatatagctctaaaaccaacaatgccacttctacatatataccccaatatagtaatgttctatttcttaatctgtggtggttcatttagtaaaaacacatgacctgtacttttttttttttttttgaggcagggttgcactctgccatccaggccagagtgcactggcacgatcactgctcactgcaatctcaacctcccaggctctgttgaccacacacagctaatttttgtatttttagtagagatggcattttgccacgttgcccaggctggtctggaactcctgggctcaagtgatccgcccaccttggcctcccgaaatgctggaattacaggtgtgatctaccacgcccagatcacctgcacgtttaaaattgtgaacttcttctgtatacttcagtaacttttcgaagatttctttgacacaaagttctcagaaatcttaaagctagcattttagaatagaaaaaaaaaagagcttttggttcactggtgaaattttactaattaaatttaaaaacaaaaagaaagctattaatgcataacagctcagaacaaagattaaaaaccaccagcacatcagttttccttaacttcgtgaagcactggtattcattctttcggcaaagaaaggatgaacaacactgtaactcaaagaaaagataccactgcaagaaaaggcttttttttttttttttagagggagtctcgctctgtcacccaggctggagtgcagtgacaagatatctccgctcactgcaacctccgcctcccaggttcaagcgagtctcctgcctcagcctcccgagtagctgggactacaggcacctgccaccatgcccggctaattttttgtattttcagtagagacggggtttcactgtgttagccaggatggtctcaatctcctgacctcatgatccgcccgcgtcggcctcttaaagtgcttcttttcgaaagcagctccaccagcaaaaggtaggaggaaagcgaggaaaccattcctcgcttggttaactcttgggtgaaaggacgccaaatgagatgatctaagaagcctcaaagaaagacagacaggcacagaaaaatcacagcaactctttggactgcaaacaccaacaccacagtccaacctaccagaaatcctgtggttaattggaggcttgccccgctagtcatgagatgattcagtgatcgctacaaacgctcctcacatgcatcctggacctggcacacctggcttgcccatcaccagcctggagacaccgccaggagcagaatcccggaggccaataaagaccccaactttgcaagtcaggggcgcgagcgctcttgcccctcaagttcccagaaagaacggcctcgagggtggggtgcgaagtcagtgtgctccacaggacttccgaagacgtgcccccgaagctgctccgtccctccaccccctgggatgccacagaacacctgccagggagtttcttccccagcgcccacgagaggagggctgcgggctgcagcggcaggcgaggaatcaagcgcagggaacttaggccccggcggagccctgcggagcccggcagtgcccggcgcaaccgccccgctcgcctaacaaaacttgcggcggcccagcccgccgcgcctcagcccagctgtgagcccgcaggtcccagactcacctcccgcccggcctggcgcggcgccctcacctccggaacgctgggtggacttcgcagtaaacttgaacttcccatccaggctgcagccgtgccgccgtacctcggccccgctcctggcgccgcaggtcgcccgtcccgcgttcccaaaatcaccaggctcactcagaagctcaggcagcctcgcgaccctcacctacccctcccagcaccgccgctatctccaccgccgcccagcaacttgcttgcggcccgctggctcctcagggtccggatgggccgtgtcaggagagcccaaggcacaggcgcagctgggccttaaagggacccggctgcctctaccgcacagcgggttcgggccgcgggccgagaaaaggagtaatggaggacagagcgcagcggggacgggaaaatccctctctcccctccgcctctctttcaaagcaccagcccttgaccctgcaattcgctgatttccccggccacttgaaccgcccctgccaggttaaagaggcgggagacacaccccctcggaagcccggagctaccccgcgtttaggactgcaggcttcgcgctgccgcaccgccccatagtctgacttccgggctcggcccgcggcgcagacgcacaggagtcggaaggcagcccccagctcccgcgagaggtggccttaggtcactcgcaaaaacaataaccaacgtgtcaatggcacttgtatttattttctaatttaaatttataacagatttcgcagatgggcttccactgaaataagcctttgagaaaaagaaaaactttttttttaacaagattaggaaataccaagaaatatgaagtaaagccatgccatctacccagctaaaaactttgaaaacttgaaattttatctaaggcaaatgtttgcataattttaagtcgtgccattatttaaagtcaatttcaattaacaattgcattgcaactaaatacatcttctataagaaaactaagatacatccctgataatctacctttcccctcctatattccgtccatcagcaaatcctactggtttttaccttccaaattttccttgaatctgtcctcttctacctcctccatcaccaccctagtctaggctaccttcacctggggagtgggggtggagggactactgacctagtctccttgtggtttacccatatcccctttatcgcctctctaatctcaacacaacaggcagagtggctttttcaaaatgtaatgtgaccctgtcacttcccagcccaaaccacttaaacaccttcccgttctcttagacaaaacctcctaactaaccaagccctgaatggccaggcgctttgcccacctctccatgtcttcttacaggtcagaccaattccatcctgctctctctgcttcagccaaactggcctcttttattccctatttactcagcttcctggactccacagagcttttgctcatgctttgctctgtgcctgaagattcttccaaccctcatccttctgacgacagctgtagtctccacctctgagaggcaacttctgacctccctacggtggtcccttactcccatcacattgcataaaactgtaatcaagtggttatgttggggaatctaccatcagctccgtaagtccaggatttggttttgtttggctcatggttgtatttccacatttgtgaaatacatatttgttcctaaatgagaacgatagatgctagaagttgaagtaaatttggcataaagtcagagaaaggtaaaatgtcacaatctgatatttggaggcagaatctaaaaacttcagttatattaaaactgattttatatcgttttaggctggattgttgcagggactctttgggtaatctttaaaactgagttctcagagagccttgtataaacacctgaattaataatgatagccctgggatggtccacataaaacgaataacattggttgcttcaagagaggaagagcgagccaggcacagtggctcatgcctgtaatccaagcactttgggaggccaaggctgacagatcatttgagctcaggagtttgagactagcctgggcaacttggtgagaccctgtctctacacaaaatacaagcaaaattagctggtagtcccaaacacctgtagtcccagctgtgtgggaggctgaggtgggaggattgcttgagcccagaaggttgagaggctgcagtgagccatgatcatgccactgcacttcagcctggatgacagagcaagatcctgtcaaaaaaaaaaaaaaaagagagagagagaaagaaagactcttgactggtggctactggtgggaaagaggtttttactacatccccaattggacctttttattttaaagtatgtgaagataaataaatgacacaaaagagtgcataccatcccatttatttgaaattccagaaaaggcaaaattaatctgtggtgaaaaaatcataacagcagttccttctaacaggatattgactgggaaggcacacaagagaaatttctgggtgctaaaaatggtctgtcttgataggggtaggaattacaaaaaattcagttaacatttcaatgaatgtaaattttatcttaaaaactataaaaataatttaaaatttaaaatctagtagctaacacctagttgagcgctcagtgtctatgggtattggccaaagctatacatacacaattttgtttagtcctcatactgtcttcacgaggtaggtattattatcataacccccttgcatatgaagaagcccaaatttagtaaatactaaataactttccttaatttataccccctggaaaatgggggaagagctttgactaccgtcagtcaaatgccataagttattaaatattagaccctatagcacttctctgaaattgtaatatttttggtatatatatatataactcatctactagatcaagagcttcacaatgattgaaatcatagtttgctttttgtttgaggtttatgggtttattttatgttattattttaaagactgggtcttggctgggcacggtggctcacgcctgtaatcccagcactttgggaggccaaggtgggtggatcacttgaggttaggagttcgagaccagcctggccaacatggtgaaacaccatctctactaaaaatgcaaaattagctgagtgtggtggcgcatgcctgtaatcccagttacttgggaggctgaggcaggagaatcacttgaacccgggaggtggaggttgcagtgaggcaagcttgtgccactgaactccagcctgggccacagagtaagactccatttcagaaaaaaaaaaaaaaaaaaaaaaaaagactgagtctcactatgttgcccaggctgcacttggactgttgaattcaagccatcctcctgcctaggcgtcttgagtagctgggactacaggcacacactatcacgcccaatatttttgtcttaagtttctaaggagtcccaacactgcacagtagctgttcaatacattttgagtgaatgattaaaaacaagcttggtgttgattttattggtacaatttatatttacatatgtaatgtttatattatatgctttttatatatttatatgtgtgtatgtatataattggcaccaacgtagcattgctgtgcttaagtgcctgagatgtatctcaaatgaatagacctgaggagagaagcttgtgtcattagctctgaccctgcagcactaatcctggtttacccctttatttcactcaccctgagcacatcaattaatttggtgaaagagcttacactttaagtgtaagcttaacatctcactgaaatagttcattccaaagaaagagctaattctaacctctcacaagtgcttgagcatttgcataagtgaaatttcactgtgtgagtttcacccaacaccacctctgctccagctcctgctactctgctgctcatactgtggaactccacaggtggagtagaagatcatcagagagagttttatttgcagtaaatttggtgtgcaacaggccaagcaacgaggagtcaaggtgaggcagaagaacagcagagggaagtggaagttggataaagggtgaactgagtaggagcggaagcaggataaagaggtgggtgagcaagaagcaagataagcagaagttgagcagcgaaaacaaaagtgagatggagtagtgagtaaaagtttatggctggcaggatccagaacaaaccagtaaaaggcatgcatatgacagagaaaaagtagccttaaaatgaccccgtatgataatcagctcattaaagctaatgcatatggactgcatatcatgggtgtacttaaaattatgggatggaggtgatgcggaagcacacaggggccaagtaactaagcaacccacctatcaatcagaaggcacatgctgggtagagattaggcagccccaggaagaggagaaaaaagaaaaaaaaaaaaacatgtaaaaagacccaaagcccaaagttcaccaaactgacgctgatctcattttgcagaagtcagcccgttctcccctctctgagagtgttactgtgcttaataagtctcttgctgctttgctacatgtgtgtgtgtcacttccaattctttgttaaagacaccaagaacctgggacttcacaacaccagccggtaacaaaggtatgtaagcttgggagggaggaaagaaagaagggagcaagaggagattcagacatgagatgcattcaccctatgagttgaaccctggtctccagcgtgggagttgacaattctattactgaaccatcaatgctccgtttggtataacctctcatagttttttttttttttttccttaaagataatctctagtgctatgggcaggcatgagggggcagggaggatggaggtgggaaagttctataataggctgacacagatatttttggaaaacagagctaacaaagcaacaggcacttgaagcaaaggcttgccgtaaaccttccacagtttgccaagagaagaaattctgtagtgaaattttcactttctctcttgtgtagatctctgtaagacacaaaagttggatgacagtcgttttgattcttggactttactagagactccaaagacgcatctgaggagaaaagctctgggtccctgggatgactgtgccactcgacatagcctcctggagtggccaaagagagtgtggataagaaaagaaatattggagtgaactttcactcactcccacttctgtaggtttcttaaaatatatgggtttagaagcaagatacttggcgttttcaaatgactcaaaagagatgtagatgaagagaagttcggtcatcccacagatcttccggagtaacctggacacatccctaaatctctagctcctgggtcttcgaaagcctgtttgcctcagggttgggaggaaagggtttggaaagtaccaaggcaagggttggcaaaaagattacctcatcagtgaggaaatgaaatttccagaagttttcgccagatctgggaccagagacaaatgctggatgaatttcctatgcaaacctcttttagaaccaccgcttcaaaggccgtccagagacttcaaattagatctggtgaaactgctcccggtaggggattggtagttcagcggtagaggtttttgtctcccacgccggcgactccggtacgactcccggccatgcaggacttcttacccttccggcaggaagggctactacgtttctacccaacgaagttattatattatacaggctgtactgcatttatggaccttggtcgtggcagctagaagctaacctgaggggcgtgccacctctggagcattctctgtgctcgaactaataatcccggaatttacgttcctgtgctcgaagcctgtccttgaaagtggggagtgtttccggtgggttgctgcagttttaaatactgggaattaaaacctttgctactttcatctagtctcccggcaaacccctgggtaacccaaagcccatcagagggattcgcgtgctgggctttccgctacgttaggccacgtctcactatggagcgaggatcaagaaggtccgggaaggagagaagctgcggggtccagggagactcttcggcggttggtcggagaggtttcagcggcccaaggaaaagggaagcgtgtgggaatctatccgcgtagagatgaggggcgcggcggagacagtcccacgcagaggtatgcccaaacaccgagttacttaacctcctcaaccaccttggcatccgcgccttccgtgggcccgtcggtcttccgggagagattctgtgtccctggtattgtgtgtcaacaggtgttagcctgatagttatatttttaatgagagaaaacgaactacagaatttgcgagttttgctttttttctggttttgctttatacctcttggattctccttccaaaggattccaatctgaggggcattgaggtgtgactatggtagacaaggggtggtgaattttcatccaaaaatctttggcggattcccttgctctcccgctccccagtctaagagcagtttaaaacagaagatcagaaacatttggagagtgtttttttctctgcgttctaatgataaacttgatttattcaattccaaaagtttccttattctgaggttgtctttccatattttgagtataaaaccatggccatactatatgttggacccacgaaggttcttctcttcacttgtttatttgtaaagtctctttgtaatctgagaatttcttgagtaaactgggaactgttacacataattctgtgtttttgagcattctttgtaaacaggaatcaggattgggggtggggagggagggaggagtgggagtcctgatttgtgtaacggaaaatcatggattacttatgtgatggagcaaaggtttaaaaactcttagcgtccccggatttccccttttactgtttgctgaagaaaattctgtccttgactcccttccttaccctctcctggcctgtgagaagcttccgccctattcaagttatttcctcctcccctccccgccccactcccccaggcagcccccttctgtttttcagtgaagccgctggaggaaagtcgggtttgtgagaagacccacacaggcaaggacagcaggagaacagtgacatagttacactcttgtcaccagcactgtcattaagaagttgtaaaaagacaaagacaacagaggagagcggagaataaaatctccgtttcagctattccaggatgttgtgccaattgtcccgtgtccttgataggaagtagtaaggagctagggacatttttcctgaaggcttccattgctggcaaaatctcattaaaggtgtctacattgataggttggccacaggatggatacaagaacaggctctggcttacctctgccaagatatatgtgtaagaatactctctgcaacattaatttttattgtaaaatagcagaataattttattattcaatcattatataatgttcaaatgtatgtgactttatttggacaatgaaaaatgcagttgttaaaaatagacaatacagatgattcagatgatgttactgatgaaaataacagatgtcaattactgagcatttatggcactcttacatacattaacttatttaaagttcagaacaaccaaggaaatgagcaacctgtggcgggcgtgagaggttctgtggcacaaaaggaagataggcattcaaagaacaccaggatagaagagccgcagtaggccgggcgcggaggctcacgcctgtaatcccagcactttgggaggccgaggcgggcggatcaagaggccaggagatcgagaccatcctggctaacagggtgaaaccccgtctcaactaaaaatacaaaaaattagccgggcgtggtggcacgcgcctgtagtcccagctattcgggaggctgaggcaggagaatcgcttcaacccgggaggcggaggttgcagtaagccgagatcgcgccactgcactccagcctgggcgacagagcgagattcggtccccaaagagaagaagaagacccgcagtaggaggaagagagaggaagtggagtcggccagctgggatgctggaagccactggatagctcaggctgagagagggcgctgtgctccgcaagcctccctgcaaccgcaggcctcgggccgccttcctccaggaagacgctccagacttctggtatccgttgagatctagtttcccttgagacgctgcaaagcgcatcgtccttgagcatttctcctctccccaagaccctccgaaggaaggatgagcggacggaagattcacaccgaagtggtcgagcgcccagatccccggcttccccgggagcatttcccaagtttctttcatgggtaagagtgggcccggcaggataatgcctccggttctatgaggagcagtgggggagatgcccacgtggccacctctgtgggctacacgacccaggccttccaggaggagcgaggagtcctgggcccgggtcagcggtgccaaaagaagcagcaaggcaaggggtcccctcctacctcaggatctctgtcctactggggttaggagacgttcatccaactccctctccaagtgttggagaggaggctaggtctttcccacgagctggggaggaagaggtggcagaggcggaagaggaagccggctgagatgtgtgaagcagctctggctataaccggtagggagagggcgcgcgggacccaggagcctccgtgcggagccaggcctcaggagcagccgccttgctcctggaaggggtgcctccctccatcttctgtccaaagactgtagggagaccttctcgcctggtgggaaagcgacgtctcccatgctttcccaccacgcaggccttgtgtcccttttcctgctagtgtctgaccgccagcctgcgggggctgcggctgccgcggttctacgctgggtggaggctgcccgcccgctagccaagagccgcgctaggaggcaagagtcgggaagtcgtgtgcaggccgggaggagtcccaagctctgggtcagggctttttttgccaatagccaaattcaacgtgtaaaagacagagagctcacatctgtctgttcgtgagcttcagtcggaacaacaaggaaggccctcaagatccctaggagggtggcggaagggtctctagcggcgatatccgcgtcgggggcggtgagccaaggactgtcaggagcctgcgtgaacccagcccccgggtagcgcaaacaccaccgcagacaagcgccccgcgtgtagggaaatcgcaggggtcagagcagctggagtgtggtggactagcctcaaccagggagagctcccttcttgaccacggtctgtccctcgccaggtaagaggagacgagtgtcagtacagcctcctctcccctagccagacgctcagggtcaccaccttcccctctgctcgcccgtcgccattcttccaaccactcgctgccaaagattccaccaacagtcacccacaggacaacccaggcctcctttcagcagaggctcccgccccgcagccaccgcgccctctcacccccgcagttctgcccgccgcctctgcccagtctgtgcacttcacctccctcgctcccgctctcccctgagctttacagtggacacagggttcgtcccaacccttcttgggagtactgaatggaaaagggggagggtgcacaattgcttggtagagtgtagacagacattgcgggatttgactgtggtactatccctttgatgtcctagtgatttttacacctgccttctgcttagggcaccggccacagttttccattagtgcctactccacctgctgtcgttgttgggtaagcgaacatcgccctcctgtaccacccagtcaataaatgggcggtcctggaggacctcacccgccgctcacccccctcccaacctcgcggccatcgcctcctgtcgcctcttccgaaggcctaagaagcatgttagctgcgaactgaggtgaggaggctcagctgaccgcctgtgtcagctgacgacgtgtgccgcacacaaacgccacgacttggcttggcctctctctctcttagttatttgcagctcagcccaatcggcgcctctgggatggcggaggcggcaaagatggtgggcttcttgggtacacctccaggagagctgccatctctgcacggtggtgtacacctgagcgagacgctcagtcgctctctaaagccccttctgcgaatggtggacacggagataaataagagggtgtgtcatgagaggccgtccaccaggacttgccctccttcgccagggtttgcaccttgcagggagactcttctgcctctggctcttggagcaggccggctgacagcggagtaaagaaagattactgcgggtgggcagtcagtgcaaaacaactccctgaccggtaatcgaacccgggatgcggtggtgaaaggactgaatcacagccactacaccagcacgggggcacgggagagtctttctcaaccttattgccatttaagtgactgtttctgagtgcgctgggaggacttgggccttgtgggggtcgctggtcgctcctggagtcgtctcacaaggcctttccctccctcctttctccaaaagaggagcccgcaggcgacacacccagcactctgcgaggcccaccaaggccctgattcccgagtcctggagcgagttgcagcgccctggctgcagctgaccactgacctagagatgtgcctttgcgaagtggcagcgcatggagaaacagtagcgggtcgctggggccagagccgcccaccgggtagccaggagcaggccggagcgaggaggctcccggggtgagaccggggcaccctgaacatcataaaggactcagaccttggcattcccgacgtcataaaggactcacacggatgcggaaaccgagacgggctggatggaaaactctttccagacagactccggggccctcaactggtctccgaccttcccctgcaacctgcgacacctgccattttcccatcttaggctccagaagcagaatcaagtgggatgtcttggaagaaaaacaaacaaaaggcccactaggtggagtgaaatggatcaggagcaattatgttcaatttcacctttaagttttctcaaaaggaggagcattaagaatcagccaccttagtacatacttaaaggtaaatattacatttaagaaaatccttgttatcttaatgtggcactgagaaaatactatcaagtacagcacgtggactaagttagaacattaaatacacaggatctcttgatagaattatcctcagactttccagttttaatcttctagatttactgaaacctgatcctgtccccgctgatgaaacatcagaggaatgggatcctgtaggtgaagatcatcagcttataaaatcctgttgccatcaatgggggtagcaggaaaatgatgaagattggttaaggggccagtggactcagcattgaaatgaatcatggacttgaagccaaaagactcagtttgtgtcccagctctctcaagcaaagcccccaagtcccagtttcctcatctataaaaaataataaaaatacttaatggacaaagttgtgtgggaatcaaatgagataaagtatgcgctgcatatgccctaaagtcttatttaaataaaggcattcttttcatctgagaaattgaagaaaaagatgccctgaacaagaaagacaggagaaaagattttttttttttttaatgaaggataaaatgatgaaatccccccaggtattgctacagaaaggccttacccatgagctgtaggcatatatccggtcctaaggtccattttggagtagcccagcactcagtctgaaagattggacactgagaaatatgtgcatcccatttttctaactagcagcattttgatcctgtcttattatccatacccaggctagcacacatgattttttctgcttgcacttcaggagaagatagtcattggacaaaaggtgggtcattctcacgttgaccaagtttctgttccagtatcaccctcccaggtaggcctttattcactctaaatagatcacactgtctaaaatagctacctttcctgcacacagtctcttactatgccatttactgtcaaagctcttctcactccctgatatgattttgcatgttgatttgcttgttcattgcatgttccctcactacaatgtaaatgtcttgccagttttgatcactaccatatccctaaggcctaagaatgttcagtacatactaggtgctcaataagtacctttttttttataagtgaatgaatgaattctatttttgtcttattccattgacattttcctgtcttagctgccttggacagctctgaaagttcttctgctattttgtacactattgtctttctctgtcatttgaatcttttccttacttagtttgggttcctccaatagtagagcttgagacaaaggtttggataccagtagtgtatttagaaggtgatccgaggattggagagaacagggagagtaagaagagaaacaaagaagaaccaacaaaaaagtgccttacctgggttgctgatgtgggcagcaggcactcaatttcatctgggtttcctgagagatgtgcagaatacctcccaaaatacagaagatggaacattaattcacacaaactgaaaagtttgaaaaaaaaattagtctttgcccttgagaaaactttactctgagtgaaaatgaaaacaagaaatgcttgtgacttattcattgtatcaaagggaattaaattttattgagtaccaaacatgagccagggactgtacctggcaaattatatatattgtcttatttcattatggcaacaggagctgccatgtatcaggcagctacaatttaaccaggttcttcacatgcatgctctcaccagttcttacaactagtcaatatgagtttttatttccatttaagagatgagaaaagttgagacttggggaaaagaaatagcttggcctaggtaacaccatcaattcatagcagatctttctgactctatagcttgtcctatagagaaacaattacatgtaaggaaaataaaaggcaatataaatttaagtgagtgactacatgacactttcttgtgaagagttataagaattcagagaacgcaatgtgcaacatgaggaccatggtcaataatattatattgcacactggaaatttgctaagatagtagattttaggtacttgtactgtaaaaaaagaaaggtaactatgtgagatggtgaatatgttaacttgcttgactgtagtaatcatttcactatacatacgtatatcaaaacatcatgttgtatactttaaatttatatgatataataatataaaaaaatagaattcagagaagtgaatgactgttgtgagctacatttaaatttaacaagattttattaagaaaattaggttttttaaaatttttaagagaaaagtggggaggagaaaatggattcctctaggccaaggaaacagctggagagaaaggcatgaagatgaggtaactggcttcatggaacctgaattatttttcatcaaagagctcaaccccccatattatctttcataaataagtagtgtgccatggaattatggaacatgaaaggtatggatttagaacatgatctaggttaaagaaaaaagaggaagaaaactaaaagaaagaagaaaatccagattgttgggatgattctgaggccctagaaccttagaaactctaaactctttcaaagtgtatttgaagagacatatattcagtgtgtgcagtctgacaacagtggaatgccaataacatttaatttcctggacttctaaacttcttaacctgttgtgctgctggaatgggactgtaaatcaaaatatgctaaattgtatggggaacatgtgtatttagtcattccaaactgcccagtgattttttaaaacactcctcacaatagtatttatgctggtcttgtttttcataagtctttcttctcaaccatgctgcaactggttaatataggcatcaaacacagcacacaagaaggaagaatgcagaaaagaaattcagaaatggatgagaaaggccaaagtatccctgacatctctcccatcccaactgttctaaatgttcttccattttcaaacactacaacaacaacaaaaaattggaatattgctttgggtctagtaaatcattagcaaattaagaacctgtttttaataacatttaacttgtaaataatgcattaattgactagcctgaatgttagtttgagcatttgaaactctgctactaaatttgtaatgaaagaaatgtgctgcaacagtaggctatatggtgaatataacagattaaatatgacagttgatatttgtgaaaatggggttataattagaggacacctgcagctcttttccaaccaaaacaacagaaattaaacttgcataaattgtgtgtgtgtgtgtgtattgcattttctattggcatgtttcttttgttatccttgagtcttgtgttaggttttatcccccgtttttcaggtcatatgttaagcaagcaacaagtggccttttgctggacacactttattggatctcaaaatgacacatttttgggaggaaaagaaaaaaaggacacagagatcttttttcctaggagttaggagttactaaaattcatgagtgatagcccagcatattataactgctcagaattagaggaagccatgtgaaaaggaaccagtagggatttcagtctcaactgccttgcctccaactatcaagtaggatttctcagacgaaaacatgaagaatgtggcaccctgccagctatacattattaaaattatgcatggcagtgagtcaggtagagaagttgctagacatagggattaaaccaaagagaaactaaatatttgcaatgactaataattaacaaagtgctgtcatttcgctaattcattgtttctcattcattcaacaaatatagataagcaccttgcagaggctatactaaactaggccctgggatacacagctgaataagacacaaatcctatgccctcaaaaggctgaaaatctggtttgggaaaatatctgtaaatcaaaagaaaggcagatcatgcaagtcagagaaagagatgaaatactaagaaggaaatcttggcacatctgtcaaatgcaacagggaagttaagaaagataaagacagaagcatttctgttgaatttgtcaatcaaagttcattagtgaccttggcagaaactattttagtggagtgttgggaacagaaaccagattacagtgagctacaggatgaataagaaagagaatgtagaaaagtgagtgtagactgctcttttcagaagtctgactatgagagactagagacagagaaagagagtgaggaagttgggggtggtgggggagagaaagtatgtaaagagttggttttcaaaggcctgagcaagttgcgtatgctgagtagtggtcacagccgttgcacacagagaatcttggcatattaacatacatgagtgcacatcagttatacattttttccctatcagaagttgaaattcccttttaatattccaagtattaaattctcatttaatatgctaattagcctgcattttacaacagattgtattagagcctggatacacatccaactcgattccatgtatggagccgtagttgatttggtcaataacttgcattgttctgcatgagaacttccacaatttgctacctcattctaatagggtttgcttgaattatatgaaatcaccacctttattggtcaaaaccagctgaatattggcaatttcatgtggttcaacctaatagtctgcaggggtctggggagatcatagcatgtgaatataatgttgaatgagacataggaagaaagaaacaagatagctgggacaaagggtattgaatgagtagaaaaaaagtagtaatctttttgtttgggttaggtgtgtgttcccaagggaaataatttttgagcatgtagcttgaaagtaataataccacttttaggtagtacaaatggctcaggggatcaattgggatttagggagcggggcttttacctgcaatctgtccaatttagtcagactaacttgcaatttttacactgttaaacatcttataaatctgagaccaacagatcaaagaaaagctctttcaattgagtgtctgggtaacttgtggcaaattttttatccccgttgtaatgtgattcctccatctctaaagtgaaggcatggattacccactcattctcaatccaatgtgaaaggtccagaattctgtgtcagagttaagagagtcctggtgcagtcagcaagggaaagtaatttttccaaactgcctgtgctaaaaataaacccagggtagtctcaggggagagctacccagtccctttcacggacagtaaattcactgtggtgggaggtgaagatggactgaaaacaaatacctgaagaaagaaaaacatcctaatgcaggcaccagtggtgagttgatgggaactgagctaccactgggaatgcatcacctgagcattttctccagagcagagttgttggacaaatctatgaggagaaattcccacagcagggcacaatctgggctctggctaagttcttggaatgtcatttgtcagctgtcagaatcctatattcataaagggagaggaaaagtctcactaaaatgcaactaaagaacacacagcagcagaacctggtctcttctgtgttaacagaacaaacatgaaaatagttaagccaacatacttggaatttgtgtcaatcatgatactttcattgctcgtcttgagttctcatgtctatcatgccacggtgaggcaatcactcagaacaacccatggcattttgcagagcaccaaagaagaagaagtggtgaatcatgggcctgagacttggttacacagtgtcttagagaaatatcccagctccttctcaagctacaaaattcctcctgctaggccaagaatagatatggaatttcctatcatctctgaattttttattactgagttgcaagcagagctctttctcctattgtatttatattatcataaaattgatcttgagtatgtagaacttaagaaagtctccaaagacagatctggatgggcctctgtcttccagcttataagatgtattttgtaaaatttagcatagctgcttttattattataatacctaaaatgtatgtgattaaatacatgaactgcctccctgaaggtaagacagcttctaaattctaaagctaaataatctagcccacagggccagacataaaattgcacccagaaattcataccaaatgtcaagtcactttggggttactcctgagggctcaatgctgatcatggttaggaagaggtaatttgccccactgtcttgcttgaggatgattttttactgccacacatggaaaaagttgcagctaattatatgattgttccaaattatgagttctcctccctaaaagaagcttataatttcccatcccattgacatcaagcttggtcatgtgacttgctttggccattgaaatgtgagcaaaagtgacaattaccacttcccagtggaaactgagagccatcttgtggctccacaattgctcttctccctctgcccaaagaatggcatgacctaaatagggactcaatttcagaatgaagatatgtagagctgcaactgacctacagccaacctgtaacaagagagagaaataaatccagatggttgtaagccactgagaaatggtgattgtttgttaccagagtataacatagaaaaagctatccaatacaacagtaaaacaaacccatcaggtacaggaagtggatctgctccctgaaacccataaacgaccactctagctgtatcttagcacaaataaggaagaggaccagaaaagaaaggaagaaaggagttagggaaagaaatctcaatatttcccaaggaaatattggtggtgttctagaagaagtggctatgttacaacagttgcatcttaggacatttattcacttccaggctttcatctcctctcagtgctgcaaggaatatcctgctctaagaacaccagtttgaaaaggactggccatagatgactttggaagaccaaagagttctgtattgacctcagttacgtccttaatactctccagcaaacatacaatatttccgtagtccattaactttcctactcccctgaaaactgtttcatgcctactcctcccttctcaaacctctaaatgcccctgtcatcctcactccaagctgattattttgcttcctagttcactgagaaaataacagcaatcaaaagaaactgcactcagcctccagcaccacctccttttctcctgcatgtgtgcccatctgctcaacttttcctcctagccatgcttctagtcaaaatcaaccccttagcttgctgctagatcttattttactcatctattgaaggacgctgttccagtgattttcttttatttcttctactttgcctgttttttctctatttgatcactctcaccaacattcaaacatcttgttttctcatattttttaaaagactctctttactccaattcctactagcgattcccctttctcacacttccttaatagcaacactctttgaaagagtgtccatatcccctgtctccaatttctttccttttgttctctctagacctcactctaatcagactttcacctgcacctctctacagacactgctctgatcaaggtaccaaaactcctactttgctaagccagtggtcatttctcagtcctcattttatgcaaacaatcagtagcattggacacaatcactctctcctctttgaaacactttttttcctccactgagcttccagactctctgcttgttcagttttattactacttgtctagtcacttctttttgtttccctcgatgcttcttctcatctctgcagttttactccccaggctcagtccttgaacctttttttttttttaatctatgtttactccattgggaagctcatccaatctcagagctgtaataaattggtacttccagcctggctctctcccctgaaactcacactcatgtctttataagacatgatacatgcatggaatggatacctaacaggcatctaatagttgacatgtctaaactaaactcctaatagcctacagcagcatcacaaaaactgcatctcccacagtcttccccatctcagcaagtagcaactcttagttcaagtcaaaactccttgcagtttccttgagtcctcttttttcatacccccattctaaacatacaaaaaatcctattggttttacattcacaacacatcaagaatcccatcacttctcattgcttctactgctgccgttatagtctgagccaccatcatcttttgcctggattagtgcagtagcctcctaactgttctcctctttccgtctttgaccttttctagtctattctctacactgttttaatgaagcaataaagttatttcattaaaacatgccaaatggcactctctcctcaacatctccccagagtcttctctcatgcctcctggtaccctgctcctcatttattccatccactccagctatactggtttccttgttattttttgagaatataagacatgcttcgatgtcagcacctttacatttgctgtttcctctccctgaaaatgctttcattctctccatgaactggaagcaaagtcattatggctcacatcttccttcagatctttactagtgaagtcttccaagactagcctacttgatgttgcaaaccccacccagcatgctctacccaccttccttactttatcttccgctaagcacttatgattgtctaacatatcatatgtttgacttacttagattatttattgtctgtatcccccaacctggaatgtaagctccatgagggaagggagtttttattaactgctgtacccctaaatacctagaataaggcctggcacataggagtctcaacaaagacttgttgaaagaataaatgaaatgtttttgcaaatcaccttcttaatgcctggaaatgttgatttagtgtttcatcccctttacttggaataataaaagaatattaaggttgcaatggctttagagttaatctagtttaatactgtcatatgacacagaagaaaactttggcctagaggaggaaataagctttctgaggttgcatacctagctcctatctaatggcacagcagggccagatgccctggctcccagcccatctctcctcccacagtatcaaccaccccatcctccttctggcttccatgagtaaaactagctcctgctaatgcctctgcttttattttgtatctcatctttgttatatcatcttgatatcttcataaatctgcttttatctcattttgcaagaatatttgtataaaaataaaaagggatgatttccacagaatttaaacaaaacccctacagactctactaaaggtttcattagattctttaaagatgcattatgtataaatatgcaaaagatgtgttagaatttaaactccaggaaaaaaaaaatgtttcagaaaacatgattaacatgttaataatggcacctaactctccaaaaagtgtggcaaagattcagtgagaaaacatacattgcctgccatacatgaaacatggaggaagcgtatgctatggcacaggttggtgtgtgtggggtgtgagacttctgtgagtactagagttcctacatatccctgttgatgttacacaatattgagacccaattttctatcttaataaaaacatatgtggtgaatttgtaatggtccaatttgtcacggcaatttattattctacttcctagagcactttagagaatactttttaaatactgatttaaaaaaaaataaaaagaggcacaacatctccctgaaccagtaggtgccaacagttatcatcatctccgttttgcctatgatataaattaaagcctaaaggttatttacctcagttcaagtgcagccaagcaatgggagatatggaaccagaagctcgaatgtgtaattcctaaacctgaattagttcattgagtcagtcagccttgtaagcactagtaggcaattcaagatgaaaaactaaacattatttttctttcatactaaaaatttttcactgttcccacagagaaatagggtctacatcccatggccttgaatctgggtggtctctgtggctgtttggccagtaaagccatagcaaaagtgaagccagcccagattccaagtctacaccttatgaaactggtagctttcactttctgtctcttggaacactctctctggaaacacttagtcactatgtaagaagttctactaccctaaagccaccctactagagaggccatgtgtagacactccagacaacaagcccagctgaaccccactttctagccagtggcagtcatgtgaggaaagccatcctgaccctcctgacaagccgacccaccagctgaaaaccattgagtgtcctcagtcaatttgaaatggagcggaagaatcacccagcagaggcatgcccaaatgcccaagcaacaaggtcctgatataataaaatgattgttatttttagccactaagttttggagtaatttgctatgctgcagtagataataagaacagaatttgatacctggaagtggagtgctgccataactatctaaaacatgtggccatggttttggaaccagacaatgagcaaacgctgcaaagatcttgaggacactgttaatgagaatagaaaaacctgaaggagacttctagtgaatacttagaggaagatactacaggaattactattggaggctggagaaaaagtgaccctggttatgaagtggcagaaattttgacaatactgttgcctgttgtgatctagacaatagaatatatacctaatgaactgatggatttggctgggtttggatctctgataggaatgccagaagtgccaaatgatttgttttatgcatgtataatactgtatagaaaaaggtgagcttagaaatgaaatgtttattgtagttaaataattagttatattattttgtcatattactatgtaattcctaggaagcaggactgagatgtaataaaagaatgtggacatgtgaccagtaagatttcagaaatactacagactagggactgctctttgcttttcattctatttttgaatgagaatgccaactgcatttttcttaccttcatctcgacattgtgttttggggatggaggagcaaataatgtgtttctttagtccacaggtcgagaggaaccatacttgaagaaacatacctgaagggtttcatccatatgtgggcctgatttggatgataaaatcctgcatcttgagcctgatcttgatgctgcctgtgttctgatgccatcaggagttgagagtctaggggttttagaaagggtgaatgtattttcccataggcaaggaacataatcaatggccaaaatgtgcactgtgacagattaaaggttgctacaaattctctgatacccttccattaagaggtagggcagatattccctcccctcaaatctgggtgggctccatgacttgctttgatcaacagaaaacggcagcagtgatgctgggccagttgttggatccaggccttaagaaccaacaacttccacttaagttctcttggaacactgagtccctgactaccctaatatcatgttggaaaggctacatgtaggcactctagttgccagtcccagccaagaccagcttttcagccatccccatcactaaatttgtaaatgaagccatctggaatctccagaccagctcatttggcagctgggtatcatcaagttatctctgctgactccacatggaacaaaggaatcacccagctgagccctattcaaactattgaccaaaaaaatagtgagacataataaaatgatgttttaagccagtaagttttaggataatctgttacatagcaagagataaccaggacactaactatacatgcatagagtaaacagaggtaggcctactttccacattgaattgtgctttctaaagaggtgatgatgaattacctttttgtaaaggtaatacatttcaaatgtgctaaggatgctttctctttttcttatccataaaacatgcagacaatagtcactctctccttagttcataagaattttgagaggaacaaaggagataatatatgtcaaaggcatctgcaaagcatttctcactaagcaaatgtaagacattattacttttatagaaatttaagtaaaatacagggttttgtgcaatttaaataatcacctagtttctatcaactttggaagtttagctaatcacatatctgattcttctacatactcaggtattcatacacaggtataaaattgctgtccaataaacatagactttcttcagtactaaattaaagcagtgcttgttaataaaaaaatcagtaatacattttagcacaatgttgacatgtaacacatatattttaactcaaatatgtaaagcacaactggtattagttaattcaatcaagcatgcaactcttgaaggaggtgggaggatgcagaaaacagctagcttgaaatggaaaccacccctgtgctgtcgttctgcctcatcttggttcatgatgttctcatctttatgcacactgtgcataaaggagagagataaaggggtgttaaaatactttattctgtagcacagaataaagtgttatgaaagtacagaagtagacacgtgcattgtttcttgttaggaaacctgagactgtggaaaacttgctgaacttcaggttactgaactcaaatataatgtgatgttttatgcttttaatgatagttcttccctctcagaaacttagcatgtatagtctttgaaaggtcttttcctatatttactatcaaaaagaaagctaaaagcatataaacacatgagcacacgtgcatacaaaaaattatcccttggtagcactggcagtgtctgctcttaactctaacctttcatttaaatggacagtacacagtgaattgtccagtatctcggctatcatgtcacgcagtcatctctgcatcagctccccctatcaatgcctctttggagtcgggctccaatctgcagagcagatagaattccgaaaatcctgagcccctgtcgctgtgagcttgtttgccaagcacatcacaagatgagtggtgagatgctgttcacatattggcccattatcccttcaatatatggagcttcaaggattttcagggccatataactgaagagagtttaccacctaccagaagaaggaccaaactctgactggagaaatcttgaaggtgtaattaacgtttgtttccatcccccttcagccaacacctttactgcactcacacctgagattcagggaaagtgctaaaaaacaaaaacttttagtagaagcttcgaaaacatgggcaagacaagacccagaattcattcttatttagcatgttggactgactaagtacataaaaagcagcagaagtattgagagcttaccaggtatcctcaaaacaaccctaaaactagattatcctcctcatcctacaaatgaggaaaccaaggaatagggaaattgaggagcccactcaaggtcacatgtctgtcatttattgaaaggaaagaaacatccagctccttggacttcaaacctgagccatgtgcctggccactgaattatactgggttctgggtgaggatgagggcaataatgacagctgtcatttattgaaagacagcataagagaggagaatctgagaaatttaagataggcagagctccagtctcaatttccaaatacctccatgaccccaggcaggttactgaacatagctgagtgtcaagttttcattttaagatgggaataattacaacactcacttgtggggttggtgtgagttttaataatctgtcaagtggctggcatttaataagcacaagagattaattattagtagttactatgtgccaggcaccattcatgtattcatgtttcatttaacctaacaataaccataaaaggaaaatattatacctattttacagatatgtaaactgaggcctaggattgcctagaatcacatagttaagtcaggatttgatcccaggcctatgattccaaaaccggtgttagttacacaccgttatttggcctctctcaatacacgagcttatgtcaacctgtgccacaaatgactttttcaataatcagttaacatgtgtcagctactaatgtggtgaggctgtattgttgagttaacctattgcttttcaaattctattttatgctctaatgctcaggagaaaaagacatttaacttatatgtaacttatctctcttgggaaaattattgaatttataaatggtagcactttaagaaaatatcaaagatagcttaatttcgagaaaatgagtctggactaagaatcaggacacttggcttttgttttcctttgcttttcacaattctccactgactagctatgtgcacttagacatgtcccttaacctacaaatacctctacttcgtttccatgaagagagacatgagcttgaagggtatcttctgattctaagttgttactatttagtgcctgcgacacatatgcacatatgcacacgcagaattcaagagcctctagagcagtagtttttctcactatccaacaacatcgttgttgcttaaagagctgtttcaaagctcagattttgggaaccttcagaatctgacttggttaatcaggttgaagctggaggatctatattttgtgaacacttcccagcttcttcaggagagaagttaggcctggtaatcactgcttcagaccactttgcgggtttggcaaaataaccatgccctgaaaccacgaggatgaccgaagcctgcctcacgacctctgttccatggaggaagttcattgataaggcagagctgtaacgcaccaagtttgcatttcttggccatatattattacacggtgtgtaggtggaaaaaaaaatttacagattattttcctgtagaaaagggaatgctgccaggggcggtggctcaggcctgtaatcccagcactttgggaggccgaggcgggaggatcacgaggtcaggagatcgagaccatcttggctaacacggtgaaaccccgtctctactaaaaatacaaaaaattagccgggcgtggtggcgggcacctgtagtcccagctactcgggaggctgaggcaggagaatggcgtgaacccaggaggcggatcttgcagtgagcagagatcgcgccactgcactccagcctgggcgacagagcaagactccgtctcaaaaaaaaaaaaaaaaagaaggaaagaaaagaaaagggaatgctgtcctgatggcatcaattttaaaactggagtaaaactctagaaagcagtagaattaacctacttattagtggcatccctagtatggataattacattcaacttgagaatcacccaaagtcgagaaaaagcatgatcaataaggcccaaatacatgatcagtacatgaacaccaaacttgtattctagtagatagatttagtgagctgggatcatgacatgatacctaaacaggtaataaaattgaacatgaggggcaaaatgtattgaagagagtccaaagacaaaaacagtaatatatctatatgaagaaatgagttatagctatttaccactgtcaaacccacctgaagtcagtgtagaagggatgccaccagtcagaaaggaatgggtcatattttaaagcattaaagcatgaatatcacccagaccatcatagtaaacatgtatgtatcaaaggaccaatgataccatgtgtaaagggctgaaggttatgtaggcacagtccagtgtcaacatttctaaaacttaaggattatgcaagccagcaagtaaatgcacaaaaatcatttgccaatttaaagagaaattctgtgtgtgaacctcagtaattatttttcaagtgctattttcaaaatggagctaacaactctgtctacagaatgtttgacaattattaaattataatctacaaccacactcaactccttggcagaaaaagacatgtgaggaaaggggtgaaatggatgagagcaatatagtccttaaaaacacctggacaccctcccatataagcttcagaaatcacaaggatcaggcattcttcgagatctaatctcaaaacttcatcaggtgtttattatgtactgttaagaaaaaagcttaatgacaaactgaatcctacatagatgactagctgcctgattgctctgcccagagggtcataggaaacatagggatcaaagggtgtatccatgttcatggaagctgaactccagtttcactgtcttctgcttcccttaggtacattttattaagtcttctgggctgaatttggaaatccttgatgttggaagaaaagctgacctatttccttatgctggagcttttctgagctgatgttcctccaaaattacatttttagactaaaagataactaaccagcatcttgatttcaatcaggaaacaataaaatatgatgctatttgggttattttcttatcttattatttgttggctgggtattcacttaaaccagcctgccctatatgttaaatatcaacctaagtctaaaatattttaccagatgtcttcttagtaaaactcaataaaagtgaacagaaggaaaatccagagcacaggaccagccaaataacccaaatagactcaacctaagtcctcttcttagactcattatcacattacagtatctcttcaccaacaccaaaccccttctgaggtgacagagggaggcaagaaaagtttgtgttttgtgttatatttatttcctttgaagtcataagccacatatcatctccttttcaaaatcaaatactcctgacttcctccatcattcctttctctaatgttcagagggctcttcgtctatccccatcttccgtaaccccagataaacttaagcttgttcactgtctcaactgtcgctcataaaatatataatagagtagaaagagtactgtttgggcaggagatctgagttctaggtctaatcctgccacttgctagttttgggacctacaacaagtcttaaactattcaaggcttcagtggctttattactgtaataatgcatttggaagggttgctattgaggatctaaaattttctagctacattttctataattgtagcactattggctagctcctgaaattaagcaaagatctcagggttgtcctatggcaaatacctgaaaatgaaattattttttatgagcacagataatttttaaaaaagctgatatatgctaattttattatttaacaaagtaagaagtcaagagattgtttcattcttggcacgattcgagaaatgtgggattatgtatgttaattaaaattttatgtaaatacaaacactccaatcatcataagaggaaaaagaacaaagaaagcctagttcatatatcaaaagaaagaaaaaaggcagccacaaagaagcagagacagagagacagagaaagcataaaaaaagattaaaaaggatgatatgagttaaaaagcttctgcacagcaaaggatacaatcaacacagtgaagagacaactcatagaatgggagtaaatatttgcaaactacctcctctaacaagggattaatcaccagaatatataaggatctcaaacaactccataggaaaaaatccgataatccaatcaaaaatgggcaaaagattttaatagacatttctcaaaagaagacatacaaataaatggcaaacaggcatatgaaaggtgctcaacgtcattggtgatcagagatgcaaatcaaaactgcaatgagatatcaacccacctcagttaaaatggcttatatccaaaagacaggcaataacaaacgctggcaatgatgtggagtaaagggaatcatcatacactgttggtgggaacgtaaattaatacaaccactatgtagaacagtttggaggttcctcaaaaaactaaaaattgagctatcatacaatccagcaattccactgttggttacataaccaaaagaaaggaaatcagtacattgaagagatatctgcattcctgtttgttatagcactgtttacaatagctagaatttggaagccacctaagtgtccatcagcagatgaacgggtgaagaaaatgtggtacttatacaaaatggagtactattcagccataaaaaagaatgagatccagtcatttccaacaacatgggtggaacttgaagtcattatgctaagtgaaataagccaggcacagaaagacaaacagtgcatgttctcacttttttgtgggatctaaaaatcaaatcagttgaggtcatggacatagaaagtagaagaatgcttactagaggttgggaaatatagttgggggttgggaggctggtggagatgtgtaatgggtacaaaaaaatatagaaagaataaatatgacctattatttgatagtacaatagggtaactgtagtcaataataatttagttgtatattttttaataacttaaagaatgtaattggattgcttgaaacccaaaggatcagtgcctgaggcgatggataccccattccccttgatgtgcatatttcacattgcatgctgtatcaaaacacctcatgtaccccataaatatatatacctactatgtacccacaaaaatttgttttaataatttaaaaaactcttttaagattaaaaaataaaagcaaaaatattagttatgaaaatgaatataaatatattaaagttatttattaaaagatcaaggttcttaaactaggttagaaaaaactccagctatatactggattaaaaaatatatgtataaattaaaagtgaaaagattagcaaagatctaccaggtttatgtaaataaaaatatggtaaaaaggcttaggtaaataaaaaggcaaagtgtaggcaaaattcactagataaaacaaggaatgtaaatttagaatgccaaaaaagttagacttcacaataaaagtataagaggtagaaaccattatgtacttagaaactagtattaaactacatagctcttcaatgtactggcagaaataggtatatacacaattggagtcttcaaacagtgttttcattccttgataaatcaagtaggactaaaataaaacagatttagttaatgatttttagtctaattgttgtaatttaagttttacacttacatgagtacatatacttttcaaacatctctggagtatttttggaagttaatggtgtaatagaacaaaattataatttttataaaatcccacaaaggaaaagtacacagcccacattctaaatgtttattctaaaataaactagaaaatagtaccaagaatttaaaataggaaagtgtttatttgtaaattagaaaacatatacataaataactattggactaaagaaaagaacaattatgattatagattattcaaaaaataataatgattagaagattacatatcaaatcttacaagatagaactaaaactatcagtaggaaaagcagatttatgtgcttgctttattagagcatgagtaacataaaataattaagctgaattaaatttaagaagttaaaagatgaagttagcttttgaagccaaaaaaaaaccagcaaaaataaaagcaaagattaatgaaagcaaacactaaaaattatagtgttctggcaaattctggaaagtccagaaaaaagagagagagagccacagaaagagagagagagagttcacaaaaacaaataaatgagaaatgagttataactatagatatgagagactcttaaatgataagacaattttatatgcagttaagtttttttaattcacttatgttctgagaaaatataaatagctaagattaacttgataagtagtaaatctggataggcttttgtcaatagaaaaaaagttgaaaaaataattaattccaataaagtttctaagtgaaaaccattttactagtctttgcaatttttttttttttttaaacagggtctcactttgttatgcaggctggagtgcagtggcattatctcagctcactgcaaactctgcctcccgggttcaagtgatctccttcgtcagtctcccgggtagctgggattacaggcacgcaccagcatgctcagctaatttttgtagttttagtagacacagggtttcaccgtgtagcccaggctggtcttgaactcctggactcaagccatcagccctcaagtgatcctcccacctccacctcccaaagtgctgggattacaagtgtgagccaccacgctcagtctaagtctttgcaaattttaaaggaatagtttgcacatcgtatatactgtttcagtacaggaagagatggaaaacttacaaattccttgtagcattagcataaccataataatctaatgaagatagtgtggaagaaaaaaattacaaaccaatactacttatgaaggttgatgtaaattcataagtaaatttctagaaaactgaatgtgttacttaaacaataagaactggctggatatggtggctcatgcccataatcccagcattttggcaggcagaagtaggaggatcacttgaggccaggagttcaaaaccaacctcgtcaacatagcaagaccctatctctacaaaaataatttttttaaaattagccaggcatggtggtgcatgcctgtagtcccagctgctctggaggctgaggtagctggatcacttaagcccagaagtttgagactgcagtgagccatgaccatgccactgcactccagtctgggcagcagaatgagaccctgtctccaaaaaacaaacaactgtaaagggtctgacatcttaccctacttgcaagctaacaagttagcctgccagtttcatgtggcagaagaaatgagactttacggtcagagacaaaggattttgttgctcttggcatacacaggaaacagcataagcatcagtatgttcatcactgctcctgacccctcgcccacccgttctcaggtgggccatgtgatatgggcccaggtggacacctgcacattcagtggattgcattacaggagaggaagcctgagttcaggaaactcagatcttttaaaatgggcaataaacatgtgcctgctgcccgttgctccagagggagactttatgacactggatcagtaagaatgtttgtttgttgcaccagggagagacactatatttttaagtctgtaagcaaacctacccttcattatggaggaaaagcctctatccttgaaaacatactcccaaagagcagtcagtgcctgtgctcacaaggagtacagaaatgtgagagacccatggagaattgtctcccgacacatcattaaatattattcttaaaatgcaaggatggtttaatgtttgaaaatataataagacaaagaaaaataatataataaaattcaacatctagtgctggttgttaaagagaaaatattttttacaaatagacatattatttacttaaatatctattctaaagcaacaagaactgtcatgttttacagtgaaaacctgtaggcatttccattaaaatttaaacaaaataaggatgtccattataattgttatttaacactattctgggagttccagtcaataaaataaaaatgaaacatatgtaaaaattgtaaacaatgaaagccattattctaaatgatatatttatgcacagacaactcaggaggattaaaggaaaaactttaaaattaatgaggtcaataaagaaactacaaactaaataaaaatactttttaaaaattgtccacattgtccatatgccaacaataaccagttgttttaaacaatgtgaaatcataataactatttatataagaatctattcccaatagcctccaaacatataaaataatagaaataacctgaacaagaaagaatgccacattcatgaggacaaattcagtacctgagacatgcaagagaaaatatttaagaagaaataaattacaggttcctagatggaaaaaaggaattctgtaaagatattaaatacttccaaactgagttgcagatgaaactagattctaactacattcccactaagattttaggacagagatttgataaaataatttttaaatgtatgtggaagaatatcacatgatgataacaagtttctaaaaataaagagtactaaggtgggactcatccttctaaatattaaaatattccataaagctacagtaaaaacttcaacaaacaaataaaaacagagtgaaattacagaaaaattagtaggtagtgcaaaggagaaaaacagaaaccagaaacaggtttggaaaccagtggagaaaggatggtgttgagtcaactgtttgtttgttttttcttcaaaacaaaacaaaaaacttagaacggttctcttatatcaaataatttctggatgtcaaaagttatacttttaaaataaaaccatagaatctaaaggaaaatataggtgaaaatctatttattgggttggaaagacttcctaaacacaaaatcaagatggaataagtcacgaaggaaaataagaatagatttaactgcataaaaataaaaatctgtatatcccaaaagtcattataatgatattcaataactacaataaaatattatttaaaaaataacagacatattcaactatagaaaacaacatcaggtagagtttacaagtcaagctacaattggtgcaaaaaagtttgtgtgttatttatgatgtagaatagatgaagggcgatagactgaagtggctaggaacatgggagcaaatcccagctcccttacttgcgaggggctttcatcatgcctcagttccatcatctgtaaaatgataacaataatactatgacctcacagggttgttgggggaattatatgagaaaatgcagcttgacccagaataaatactaaataaatgttagcaatagtaacattagttgaggtatagggctataactattaatcgttacattttttttctcttgactcactatctcccctcatctaaattaggagcaagttgagaaacaactgcaggaatccagctgatgaacatctatctataatcctaaaggttggccgggcgtggtggctcacgcctgtgatcctagcactttgggaggcctaggcaggtggatcacctgaggtccagagttcgagaccagcctggccaacatggagaaaccccgcctctactaaaaatacaaaattagctgggcgtggtggcgcatgcctgtaatcccagctgctccggaggctgaggcaggagaatggcttgagcctgggagttagaggttgtggtgagccgagatagcgccattgcactccaccctgggcaacaagagtaagactccgtctcaaaaaaagaaaagaaaaaaaataaatcctaaaggttgactaaactgcattagagaagcagctcaacctgtggctacaagcctaccacttttccttcagaattaaacacttccatccccaactgcatgtctgccctacttagatgcctgaaattctactaacagagttagtagaatttaaagagttcttcctttaaattaaggcactgcaattggaaaagtctagtgtaaagtatgaatagcgctagaggcatactacctttcatcactttcagctatagcattgcaatattgattaatttgttatattttgtatctaattatattgctggttaaatcctgagtctcaatggaatgtgacacaggacaaatagatttgatagaagaaggaagtattaggatatgttctaaaggcttaaatcattttcaaaaaagctacacattaattaatttgattaactaactagaaaaatatgcccacactgattctgatggaaacataagtgatggtgctgattcaagtcctgctggccactcaccagctacacgtcctcatgcatgtcagcctcccaaagctctctttctctcctgttctgggaggacaatcgtgcagtatgttggtggagattccttcaaggacaaatcatgacacaaggattgagaacacgcttgggcagaaatcccagagagcaatgagagggaatggtaagtgagacaggagggacaggagacaaaccaataaagtggctgccatgaggttaccactaggccactgctgtcaatctttttgaagaccctctgggagacctgggaacctaccccagaattgtcccaccatggggaataggaagtcaagaaattttcccagaaattcctacccctcaaaggttgaggattactcctggactgagcacctctagcttagccctcaatttaccatcttctcaggaggcgagggcaccctctcaggcaaagggacacagctgtcatgccatctggcctgcatgagacctcctggagtaggcaaggagacagagagggcaccaaaggtattcactgcatgtacagccacttcttatagctgttgagctcacacagtgatggagaaaaatatgaatacaatgtgcaacataatgttaggcacacaatgaagggccaataaatggtaattgtggtggtgaatgctgctatattttttaaaatcaaggcaggcctaggtttagtgtcatagcgaaggagccaggcaccatagccagaagcccctgggtaggtctgggaagtcctaggaattgggaaaggtgaaaatagtacaggtatggggctgtaaaaggcaaacttcatgtcctgcagtgttctgcctgtggctggtcctgaggagcactggtgggtcagtttggccagacctccaaagagagccacaggaaaaaaagaaggctagaggtcctcatgacccacctcccaagatacaagcagacacttgaagtggaaaatccctgccactctgtaggacaagaactacgtggccaaaaagggaagctgcaataaatagttctggtttaacctgggatgcatcacagcttctccaaagttttgctttgactttaggcccaattcaaccaacatgaaacacccacaaattaactcccaggaaaaacatggctctttgagaaaagaactgacacttagtaagcagctgagcctgtcagtccaggttgcaggatggagcgagtgagctctcggcgggtacagtggcttgcactagctgaattcattactattccctttgtgcagccttgtgctttgaccactcgcatatatggaataggacttacaaaagaaaactgttttgtttggcaggtgggaaatcatttcaattgagatattttttctgtttactcaagtaaatataaagatgctttgattttccacaaagaaagagttgttatccctatttgaatttatgttgcttcaaaaacaaacatcttacttttagtatcagaagcagaccattctgttccttagggaagtgatattctttagtagactggtgggagacttgtagaatattaaaaggataagacaaattccagaataaataacagggaaaatttattttctgaactctaataactatgatctgttcctacagtagaatgggcattcaataactggaacatgaaggattggcctacagggaaagcccagggtggtctgggacctccctgaacctccagcagatctcatgagactgtctttaattatccttttctctctctctctccctctctcaggcctacaatgaacactgtgtggggaaaagaaagagagatcagactgttactgtgtctatgtagaaagaagtagacataagagactccattttgttctgtactaagaaaaattcttctgccttgagatgctgttaatctgtaaccctggccccaaccctgtgctcacagagacatgtgctgtgttgactcaaggtttaatggatttagggctatgcaggatgtgctttgttaaaaaagtgttgaaggcagtatgcttgttaaaagtcatcactattctctaatctcaagtacccagggacacaatacactgcagaaggctgcagggatctctgtctaggaaagccaggtattgtccaaggtttctccccatgtgatagcctgagatatggcctcgtgggaagggaaagacctgggaagggaaagacctgaccgtcacccagcccgacacccgtaaagggtctgtgctgaggaggattagtgaaagaggaaggcctctttgcagttaaaataagaggaaggcatctgtctcctgctcgtccctgggcaatgatgtctcggcgtaaaaccgactgtatgttctatttactgagataggagaaaactgccttagggctggaggtgagccgtgctagcagcaatattgctctttaatgcaccaaggtgtttctatacatgcacatcaaggcacagcacctttccttaaacttatttatgacacagagatctttgttcacatgtttcctgctgaccctctccccactattgccctattgtcctgccacatcctcctctccgagatggtagagataatgatcaataaatactgagggaactcagagaccagtgcctgccggtcctccgtaaactgtaagctgagtgcctccgtaagctgagcgccagtcccctaggcccacttttctttctctattctttgtctctgtgtctctttctcttctcagtctctcatcctacctgatgagaaacacccacaggtgtggaggggcaggccatcccttcactggacagaaccaatgtacttcttacatatattgattgattgatgtcacatgtctccctaaaatgcagaaaaccaagctgtgccccaaccacctcgtgtacatgtcatcaggacttcctgaggctgtgtcacaggtgcacatcctcaatcttggcaaaataaactttctaaattaactgagacttgtctcaaatttggggggttcatagtcctaaagtcattatcttatttaatggaaaagcattagggatgtttctactaacatcagaagcaagagataaatatctattatctctgctgctgttagagatattagccagtgcaattagataagagaaatcagtgaaaggcataagagtgactaaatgagtggtaaaactatatttgcagatgatataataatatatgtggaaaatcccagagaatcaataataaaactaactcaaacaataaaataatttactgaagaacacggatataaaattaacataaaaatcaatagccttcatacaaacaaacaggggacataatggtagagaaaacaccatttaaatagcatcaaaatatatgtatttatgaataaatataagtatttatgaataaatttaatgagttatgaaaacctatgcatggaaaatgtcaaaacactcctaacagacagtaataaaaacttgaataaaaggaaagacattcccaggttcttggatagaattatagctttatgaaaataccacttccccctaagttaatttataaatgtaatacaattccatcaaaatatgaacaggctattttctggagttagagattttgatactaaagttcatataaaaaaaaagatgggtaggaatgaggtagaaagacactgaaaaagaaaagctgtagtgattaggcttaccagaaattaaaacatttgataaagcctggataattaaaacagagtggtactggagcacagagaaataaagaagccagtggaagagaatagtccagaattagaccaaaatacatatggaaatttagtatatgatgaaagtggcatctcaaatcactagggtaaaacataccatatagcagtataaactccaagtggattagtgatgtaaatataaaaactaaaaccacatagtatagaaaataaatggctacattattatttagccttggtaagaaaaagcctttctaactatgatttaaaatccaggggcaattttttaaaagattaataaatttgactgcatttttttgtgtgatgaaaaccaccataaacaaaatcaaagaacaactaacatattgagagaaaatatttgtaacatacactagagaaaaagggctaatattccttatacattaaaaaaccttaaaaattgaaggacaaaatcctgagatgaaaatgaggaaaaggcataaacaaataattcatttgaaaaaaaaaggaaaagtttcaaaatggcttttaaatatgcagaaaatgcttaaactcactgataattaaggaaatccccttctcatttattgaattggcaaaaataaaacaaatatgagaatacattctgttgataaggcttgttggtgaagctatggggaaatgggcactttccctcttagaaatgcaaattggtacaacacttttggagggatattaggcaatatctaaccaaagtgcacatacatttcccttttcacctagcaatcccacttctagggtatgtatctctgacaatacaaaaatgtatatgaataaacttgcaattatcatttataattgcaaaacactggaaacaacttaaatgcccatacacagaagagtgcttgaataagctggaacaataacatggagtactatacaaacgtataaaagagtgaggaaagtctctagagtggatatggggtgctttccatgacatattaagtaagggaaaaacaacaacaaaacccaaacccaaaagatgtgattttgagttatgtgattccttgtgtaagaaatcagatataagaaaacacacaggtatctgatcctttatggaaaaaaaaaatcaagaacaataaacaggatttgaataaactcaaagtatctacctcaaaacacttatcagctacaaagagaaatacaataactgtatagttgtaaccacccaatgggttcttccagcctgctccccagagagagccaatttatcaagacagggcaattgcaatagagaaagttttacacatatagaactggctaaacaggagactagagttttattattacgcaaatcaaccgccctgaaaatttggagactatggttttttaaagatagtttaggaaaggggggtggctagggaatgggtgctgctgattgattgggggtgcaatcataggggtgtggaaaatggtcttcatgagctgctaagtccacttctgggtggagccgcaggaccagtttgtgggtctgggtggagccatccattttcagaaacgcaaaaatctgaaaaggcatctcaaaaggccaatcttaagttctacaacagtcatgttatctgcaggaacaactgggaagttgcaaatcttgtgacctctggaataatggttggtaattatttatatctacatgttaacagaattcaggttcctctcatcctcctaacctggtgatctttcatcagctttacacaaaggtggtttagttttgaggaacagatacaatcttttaaactataaactaaatttctcccaaagttaacttggcataagcccagaaatgagtaaggcattttggaggttaaaagcaagatgggggttggttagatcagatccctttcactgtcataattttctcactgttatagtttttgcaaaggtggtttcataatggagaaaacagcagacactaacctaatggagtgctcaaaataaataacaccattaataaggcatatatcagcatcatgaatcccttggcatgatgtgctgaaaagggatacagtatcatttctgcggtattcttgccaaaatggcatgacttcactctaatcatgacaaaacattagacaaacctaaagtgaaggacattctaccaaattactaatcagtgtatttataggtagacaggcataagcagggcaggagtgggcttttcccccacccactaaaaatgtcaggtgatggtttggcagttatcacattgcctctctaaaagtgataaattggcagccagcaccagggagaggccttttcctgatggtccacacctgttgcactaaagagtgaactgagtataggtgccagggaaacacaacttcctagacatgcgtattaggagataaaatggcagggtatgaccttccaagggcacgccatgagaaaagggaagaaagcctctaatgggcatgcatacaacttcctaaacacagtgcacatgctcatctcccaagggtaaggagggctctgtgcatgagggcagcctactttaagggaagaatcatgggaaagaggccagcctataaagtcttaggatcaaggttaaacactactcttgaccttcacatgcccacttgggtctcttccaagcatactttcctttctttcctgttctaaagcctttttaaataaactcccactcctactctgaaagttgccttgatctctttttctgccttatgcccctcagtcaaattctttcttctgagggggcaagaactgaggttgctgcagacctgtatggatttgccaccagtaactcggataccttccactggtaaaaatcagtatccttcaaagagtgccaaagttatgaaggataaggaaagactagggaactgtcacagattggagtcaactagggagaaatacaactcaatacaatgcggggtcccggataggctcctgaggcagaaaaatgatatttgggtctatggccataccaccctgaatgcacccaatcttgtctgatcttagaagctaagcagggttaggcctgttagtacttggatgggagaaaaatgatatttgcaggaaaactggtaaagatcagatgaagtctgtagcttagttaataatattgtaccaatgtcaatttcctattcttgataattaaaatgatgagagagattcaacataagtggaagcagggtaagggattaaaggaacactttctagtgtttttgcaatttcttaaagtctaaaattcattcaaaataaaataatgctttaaaaccaaaaataaataaatgaaatgggtctcttctattaagggttttctagaaacctccatctttccaccactctcctataaaagttttaaaacattttcaaaagccacttatcactattcttagactgccagtgatcaaaagggcagcctcgcgggttgcaaattagtgaagaagagaaagctagaaggaagaggaagtggagcatctgagggaaagatttttaaatgaacttctttgtgttgctaaatttattcgtatcctggaatgggctacaaccatcacaaggacataaaaatcatcaggtaaattcaaggactttttaaaaatgcatctaatcacctcctgtccaaaacattcaagcttaacctttctcttgaaaatgcaatctgctctttacaccctgcctgcataccagattctgagacctagattgccacaggagcagaaccatcaccttgtcctgattcaataggttcttgttgttacattatcagcttaagatcctggggtatgtggagatgtgcctattcattactgaaagagttcatgcacaatttatgtccttcacataactttgtccttaaaggctattttctgaatccatttcagttatgttttcccaacagccatattaggaggtgactgttgtttttccatattcaaagtaaaagaaatgagacaaatatctcaaaatgattgaggtgctcacaataaaaatgtagtggtaaagatagtaccagatctcgtgtctgtagcttctgtgccctctttcatagtccagaggactgagctactctagcaaatgggtatatgagaactggtgaccacagttaatccagctgacatgacaccagccattacattcaagtgcagtgatgtattttgcattgctcagctctttctacttttcaaagtcctcttcacatatttcattgaatttgattctcaaaccacattgtaatgtaagtagaatagctatttccttttagtaatcgtaacatcatgccattcaatatataaataaagcccctttattaacattaccttatctaggtcccactaaaagaaaaaatataaagtagtagtgtccccattttctagataactgaggctcaaagattgactggtccgaagacacccaggcaatgaaggggaagatggaatgtaagagcaagtctttttgactcattatccagtcatatttcccccactgtgcaatagctgcatagcaaaatgaagaaaaattacaagtttctgactatgagtccaaaaatgagttaacatgtgattttatgctagaagataatctaatgaggtcactctgcttagctgcttagctaccgctgttatcccaatgggactgggcaagaatagaaccaagtcatgcaagtaagagtagcacctgattgggcactgggcttggattcaggttgttatctctatggatagctgtggttcactgaggaaccattccaaagatgttagaagagccagacagaacctacattaattcattggttaaagctcagaaataatcatgaggtctctgagacaggagacaattagacataggatggctcctattatacacaaaatttcattgagtcagctctctccgctttacttcttgccctagtatatcttaaatatgtggttttccccttgcctaatccaggagagctggatttcataactaacaagactttagacttgtgcttcacctttcagcatgcttctgggttccatgatgtcccagagcctatgtgcttatgattaaaaaaaaaaaaagaaactgaagagggaccccagtctgcaggagtgagatgggcatgggaagaattacattttctctggttcctgggtatgctgaagatgacatccaggagaaaacttctggcccctcaaactgccccatagctcagcctgcgggctgcgacttacagtgacatcagcaacatgatggattccatcgccagcagcctggactccaggaggcaccccaggcgtggccgatgtgcacaggtaggagcatgtcctctgcgtggcctctgcactggaagagcttcaaggccttttcctccagggctgaggggatttgtgtttcgcctctgtttgtttttgtgtacttctgtttggcgaaactttcaagcacgcagagcaacgttctgatagatagtgcagagaggagctgcgcagcatcctggagccgaaagttacaaggaagagaccaaaaccggtaaagtcacggatgttgtggcccgaacctgtaaatccaaacaatctcacagttatgaaatggaaaatttgtggggaaaaacaaatgctttggttattacagtgttactacattcataaaatgtatttcatttgggggagtttacactgggggtaatgagatttttgctttatgcgttatttataaccgcttaatccaggtactgtgggtttttttaattccttcattttcacagctacaaaacacttcagcatttctaatttatttctgcttacaatacagatgttcttagttgtgtttctaactatatttcaaccgttacgatcacgtttgtttgtgtcagcgcgcaagccggggttgtatgtgcaatacacaatagtaaggcttcaagaagcctgtaaaaaggcctcttgtgctttcattatcaacaaattaaaatatgctgcatggcactatctttatcatcagtggttttaatctttggataattcccctgcagttgggtaggcagagtgacagccctctctcagtgtagaaagactgcatgccttaaaatggcacttttcaagatgaccatttggaagcaacatttggagaacacttgggttatgtcctctaactgaatttccaagctgttggtaacggactaaagaaaatgtagtctgtactgaatattaaggaagcaagagtgtaagagccttgaaggtcatgtgtaaatattgacattttattttatttagtaaccaaattggggcccttgcattgcttatcttgccataaaaactcctcactcactttcactgccctgcagattgtcagggaaagatctgatctgagcagctctgggtgctcttcctgccattgctaacaagactgaattttgtttgtgcaaaatctgagtcagaggggtgttcctcccctctcatctccaccacggactgatgcacctgattagataacagaaatttgtgggctgaatgttcatgtagtgacatgaaagccaagatgcaaaaacagtcagagaaaacagcctcccactcactcagagtcaagtcaggtgtctaaaaccaaagttatctggggaaccaataactggctaatttggccagaatacccttctctgtgtcctcagcagcagtgtgaggaagaaataccagcatgtcctcaggccctgtacccttctcagaaaccaggactctacctgcagagcttaatcagggccatattctgaaggtgagatgcaggcaatggccaggtctctccaccagcagcagtggctagaatgccccacacacttaacaacttccgggacacatttgactgttgacctacaacagcattgctttcctctgccaaagcaaagagctctgctcatgtagaataggctggcagtttggtaacttgccagaggctcctgtctccctacagtgaggtcaccagaatcgcttccctcctgaaacacagtcgattgaaatgaaggtccagcagaaattaggggccagtgagttaaacatggaggccacttccaatggtctttagcctaagaggttttctccaagtgaaaagaagaaaattgaatatgggaataaaatgatcttttaatgcttcataactcaactctctgacttacctcaaaaagagagaaatagtgtaaaaagccaacactgttttctgccctctaaatttgagttttgaaaggtgctcctcaaatattaatgatctggtttctgtgcccaaataaatgtcatgatttacaactcatgcttatggttgcaatcctaatcacccttccctacggcagctttataagtcttgcccagttccactactgaaatagtgcacttggattcaaacaacactcaaaaaccttgttttttgttttgtttcatttttaactattactgagtggacagggtcaatcccattcaaaattcccaagtagacaaaatctgtctgtggcccctccccttcccctcaccttcttggccgcctccctccattcccactgatgaacttccaagcttcctacagctccactagtccttttcaaccaatggaaaacaaagcagtttcctacattagtgtatctgccttcataaagtagtttagtgttttgcacaaaccaagagaatgttcattttaaaagcaggaaagaaagattacagatggaatgtcagacaccagggcacctggataaaatataatttggggcaggggagtatattctcatcttacctaaagtagacgaaccagtcaagtcagtacccataaggtaggcttgataaatctcaggaccaggcacctccacccccaacaaacacacacacacctttccactgtgatgttttaggcacagtgtattgtagctctgcctatctactcagaacctaatgtattcacatgaaagtaaactaacagagtctggctgtcctggtgattctcaagaccctattgcctcctcacttacccaaaaggaaaggagcagtagttttgttttttttttttttaattcaagaaatcagcaaaaaaaaaaaaaatgtgttagtgtttctccaaaacttctaagttagagtggcacaattcattttttttaataaagaatttgattaactctggttggcccagatttgcttcagcctaaagcccaacatctcttttgcagcgtggtatccttcagttgctcatacttgagccaatagaggtgggaggggagatggagaagactggttttatttgagcttgtgaaaatggctttttatcaagttcaatgtcataagttttcttccacaggaaagtagaatatattttctggtgagcaatagttttttattatatagaaatggttcctaattcttagcagacagggatttgagaaaacaggggagttctccgaagtcacaacaaataatgtgatggtcaacgtgatagactattgtacgctttgatagctagtttcagactgattttctgacacatgagagaggagcagtgcctgttgcccatggaaggcgatttgctgggaggaggaacacaaacatccccaaaggctaccaggtcaactgtcattttcaaaattaccattaaaagtaggctggtgggccgggcacggtggctcatgccagtaattccagcactttgggaagccgaggcggtcgtattacaaggtcaggagttcgagaccagcctggccaacatggtgaaaccccatctctactcgaaatacaaaagttagccagatgtggtggctggtgcctgtggtcccagctactcaggaggctgaggcaggagaattgtttgagcccaggaaacagaggtagcagtgagccaagattgtgccattgcactccagcctgggcgacagagtgagactccgtctcaaaacaaaaaacaaacaaacaacaacaacaaaaaaaaacaaaaaaaaacccacaataattagctgagtgtggtggtaggtgcctgtagacccagttaactgggggttgacgcaggagaatcgcttgaacccgggaggctgcagtaaactgagatgaagccactgcgctccagcctgggctgcagagcaagactctatctcaaaaaaaaaaaaaaaaaaaaaagtaggctgggcatggtggctcatgcctataatcctagcattttgggaggctaaggtgggaggatcacctgaggtcaggagtttgagaccagcctgggcaacatagtaagaccctgtcactacaaaaaataagaaacaattacctaagcatggtggtgtatgccagtagtccagaaattcaagattacagtgtgctatggcaccactacactccatcctgagcaacagacaaagaccttgtctctgaaaaaaaagaaaagaaaaaaattattattaaaagtaataagaatagaaaacataggctgtgtatgctagattaacaaaacattccccctacaaaagggggaaatttcaattttctatgaagtttgaaatctataatcatctggcattatttccaggcatgtagaaaaaaattcatttgtcttttcatctggattagtttgtctccatcagtgtgtacatcaaaagtacctggggattctgtgggtttggggaacatttttttgtttgcttgtttgtttgttttcaaaatatatggtagtatcccaccacaaatctatactaaaataaaatttcgcagtgtatgtcaaataaatgtgcactttgaaaaattccccaagtaaattttgagattggctcttgattcagtgacactaatataaacactttcacttacttttgaattttgtggtgaccgatcttaagatttgaagcctacaccttcttaacttggtccatgggggcacaaaaggagagagagtataaatgctgaggatgaccttaacaaaagtgaacacgaaattaagagatgtgaacccaaaataaaagaaagcaaagaactctgtcttcccttgtcatctttaactctgctctatcttgattcttctctgtgtttttcacaggctcttcttcctatacccactctgtaaagtgatttaccccatagctctccacccctttcaccttggatctctggtcagataatctcaccttcctctgtggcttcaaagccatatacatttgacttctgaattcatctgctagggcagccataacaaagtaccacagactgacttgggtggcttaaacaacagaaatgtattttctcacagctttggaggctgaaagtccaagagaaggtatttgtggctttggtttcttctggggcctctctccctggcttgtagatggctgtctttagcctgtgtccttacaggacctttcctctgtgctggcacttctggtgtctcttccccttcttacaaggacatcagttctgtagaattatgggccaccctaataactccattttaacttattacctcttaaagaccctaatatggtttggctctgtttccccatccaaatctcatgttgaattgtaattcccagtgttgaaggaggggcctggtaggaggtgattgaatcacgggggggcggacttccaccttcccgttcttgtgatagagttctcaccagatctggttgtttgaaagtgtgtagcacctcccactttgctctcgctctgttctgctggccatgagaaaatgtacctgtttcccctttgccttccgccatgattttaagtttcctaaggcctcctcagccctgcttctggtacaacctgcagaatggtgagtcgattaaacatcttttcttcataaattacccagtctcaggtatgtctttatagcagtgtgagaagggactaatacagaaaatttgtaccaaatagtgaggcattgctataatgaaacctgaaaatgtggaagcagctttggaactgagtaatgtacaaaggttggagcagtttggagggttcagaagaagataggaagatgagggaaggtttggaacttcctagagacttgttgaatgattttgacaaaaatgctgacagtaatatggacagagatagccaagctggtctcagatggagatgagggacttactgggaactgaagtaaaggtcactcttgctatactttagtaaagagactagtggcattgtggccctgtgctagagatctgtggaactttgaacttgaaagagattatttagggtatctggcaaaagaaatttctaagcagcaaagcattcatgatgtggcctggctgcatctaacagcataaactaatatgcatgcacaaggagataatttgatactggaaattacacttaaaagggaagcagagcataaaagtttggaaaatttataccctggccatgtggtagaaaagaaaaacccattttctggggagaaatttaagccagctgcagaaatttgcataagtaaagaggagccacatgctaatagcaatagccaagaccatggggaaatgcctccgaggcatttcagagatgcctcggaggcatttccgagacctttgcagccgcccctcccatcacaggtctggaagcataggagggttatatggtttcatgggtcaggcccagggccctgctactctgcgcagcctcaggacatggttccctgcatcccggctgctccagctctagccatggttcaaagggccccagatatgtcttaggctgctgctccagagggtgaaagttgcaagcctcatggcttccatgtagtgttaagcctgtgggtacacagagggcaagagttgaggcttgggagcctccacctagatttcagaagatgtatggaaatgcctgaatgtccaggcagaagactgctgtaggggcagagccttcagggagaacctctactggtgcagtatggaggggaaatatggtcttggaacctccacacaaagttcccacttgggaattgcctaatggagctttgaagagagggccaccatcctccagactcagaatggtaaatccaccaacaactttaagctccattattttggagctttaagacttaatgactgccttgctgggtttccgacttgcatagggcctgtatcctctatattttggaatgggagcatttacccaatgcctgtaccccccattgtatctgggaagtaactaacttgtttttgattttacaggctcatatttggaagggacttaaccttgtctcagaagaaaatttggacatggacttttgagttaatgctggaatgaattaagactttggggaactgttgggaaggcataattgtgttttgaaatgtaagaaggacatgagatttgggaggggctggggcagaataaaatggtttggctgtgtgttcccacccaaatctcatgtctaactgtaattcctagagttgggggaggggcctggtgggaggtgactgaatcctgggggttgactttccccttgctgttctcctgatagagttctcgcaaggtctggttgttagaaagtgtgtagcgcctccccctttgctctctctctctttcctgccagccatgtgaagatgtgtctgcttcttcaccttccaccatgattgtaagttttctaaagcctccccagccatgtttcctgtacagcctgcagaactgtgaatcaattaaacctcttttcttcatatattatccagcctcaggtatgtctttatagcagtgtgaaaacaaactaatgcagaccctgttcccaaatacagtcacattctgaggcactgggggctgggaattcaacatatgaatctggagagacatggttcagaacataacaacttccagttatataacttcaatgctacgtgatgactggctcatatatttgaaaaactttcacatgaaaaagggacaagacaaggaccaatgtgtggaaggtaaaagctgaaattttcagctgaacaaaaggaaggcctatgtgataatgaggggggtctagttattacaggctgcattccctgatagtgtgtccctgccacaggaagggcacagcagaggctgagtggaccactatcgtgcctgtctttggggaaatccagcataagcctccaaaatcccttttcctcttttaatttgatgacattaatgaaggaatatgagctcacagggattaaatcaagatgattaaaacaaagaagtagaaaatatgatcacacgtctacagtgtgtctacaaacacggcataatcagatatgagaaaaaggagttttgtgaaatgttagagtcacaccctccctgacgtgagcaatacagtggccagcaaggcaggagaggatgtgctctgtatcaagaatgtgaggcctacggtaaagctgaccggtacaggtggagcaagaccaactaagaagcatctttccctggagaaaactgtcactcatcaagaggatgtccatggcaatctaagtggagattttcccaaagggactacaaatgtcagaacccaggtgatctgacatcaatgaatcttcctgaaagccccttgggatgtcatctgatgacatgagttagcattggtggactagggttggaagatctgacttgagagccaatttctctgtgtacactagtcagctgacctaaggtgtgtcattgccttctctgagtctcaagctcctcatctgtaaaatagaaagaatatggccttaccctgacagcatattgtaaaaattgatgagatatgatttaactataaatgtgctatgaatttaaccatgcagtttaatttatgtaactgtgaattgtagactcttatttaaacatgtggtattaatattattgtcatgttttcattttgcccaatgtgatggtcaataccgtgtgctataaatgtaagtgagctcctcattagatgcagcatgaaagattctgagggatgccctttgataatttgattcgctcaaaaagatacagacttcctagtcacaatggggaaagtaatccagtggaggtattcatattccaaaataccactgggagatacagaggaataaaaaattaagaaattccatacatcagaaggacaagagctcttgaggttctttcagtggacagtggttttagacttcactgtgcattagttctgtccaagatgcttattacagatgaaggctctccttcactagaagccctccccatcactactcttgattgcatggttcagtaggacaatactttgaaaaacatttccctggtgagtgaattcaaaccctcagaagagggattccatgcttcatacaacactatggaggctttgaagtgtttaccatacttgggttctattggcaatatccaggggtgacttggagtttccttaaggttcctctcaaaaatttccatttacttaactccgagatatgtcaaaataagcattcaagctaagtaaaaaattggtgcttgttagacaaagccgcttcaagacaatgcccttgatccttcctcctctccagggtgccaccctaaacccctctacctagaaattttggatttgccaattgcccagaaggatgaaagcctcacagtgcaatcattgtcaagtcctgctgagctgtgtgggagctggcttatgtggaactgcctgagcttctcaggggcctcctcctggcacatcgagctcagatgaaatggaaggcctcaaagccccactcaccccaccctacccaccttcatttataccagttcacagaagaataaggaaaacagacaaataccgtatctggaagatatctccaaagacctaaagccctaaataggaaactgagaaatttgtgggaacctttagaattttgatctcttcatacacactgctagtcactgttactgagaaagtagcaagaccagctttttccattcattgtcatctgctcttgacatgctggactcacctgctgtgtctccagatcatgtgcatggctgcatgcagtctagggttctccaccaacaggcagatccacctcaataaaggaaattacttgaatcagtgagggacaactaacatcaggtgacattttaaggtaaactcttttatggctatactatttctgtctttactaagtatacttgtaatctgatcagtagagtataagtagcctgctctctcataatatttttgtagaaatcaatacagtgtaatcaaattggtgtcaataggttagattccttatttgtaattattgagggttttcatatcttcattgaaagactattggtttacatcatgccatttgacttttggttcaagtgctttcaaagaaactgatttcttaaaatgcatccttgcaagcctgacagtctaacagttgaaaatctatgcaagaccataaggcagactaaagatgggtgagaaggcagggatgggggtaaccaaggacagagatactaagtatacaaatagatgttttccagccaaagctggaggagcaaatggagcaactgctaataaaaagtgggcatgtacattttgatttcaatatttaaaagtagcccagtgttccattaaaaaaaatgcagccactattcaaggaaaaaaatgtgtgtaatatgtatgtgtgtgttacattaagaaaggagttccacttcaatttctgggcttcataagcaatcatccttgtgatctttcgtttgtgcagtttcatagtctacaaaacactttcacaaatattacttattcatccaacaaacatttattgagttcttcctcacccccaagcattgtgccagacactggagatacaaatatcaagaaataatacttaccttcaagaagtccacagaagcaatctgcaatctcttaccctcaacaaatttaaggaacagaaatatctttgcaaagaacagaatgggaagatgattttttaacttacaatgccctgctacaatccagatttccaaaaccctaggaatgataaaggagagaaaaagatcatgaatttcccaatattttgagaaagccattatactgcttctcattcattagactccattgctaatcactggagtttcatactgtttaaggaggcattcctccaatgcctttctgaaagtttctagggatgtcctaatacctacagacatctccatttgccatacacctggactgaaaggggatagtattctctctccttaattgtaataggttaggcattcaattgacaaataaaccttgagtacattaacttaaaacataattgaggatcagctatgatgtgtcatgcactgattggaattataagagatgagtaagtccatgccccttgatcacaagtaacccagaaagggagaaatatttacaaaaagctaggtaaaataaaatgtaaagcaactgctctccagtagtgggaagggcatgccctagggcagactttttcacctagctaaacttcccaacctctgactcctgtcttcgccatgctacacgtggtaggacgagcatccgaaacagacagctgacatgctttaggcactgtgttgtgtgcacttagattcttcaaaattctggaatgggaatatgtcctctcagcccattaggaaacaagccagcctaacttcactttttaaaaaaaatctcatcagattcatcttattttgataggaatattgagttaggtgactagaaagatatagggaatcttgacttgaacaagaattctgagaaagtctcaagatttcttgctggtcaagctggaaaataatttgtaccaaatgataccacacaagattaattcataatatttaaatgacagtgccctaagggtgctggtgagcctagaggaaagtttctaaagatatttctttgcctgtgcccttagctctgtattatccaaatatgttacacaacaattcagatgaaggtatagaaatcatgcacaattaaaatgccaatgaatgtttaaaatcttagaatatggcaaataactggcactgtgctggctcatgataaatatatgtttgactttctaaaatgaatgaatgaatgaatgaatgaatggcttatacagatttgaaaaggaactaacactaaagaaatcacatgtaatgggataaatttaagatcctgcactagtatccaaaactaaatactaaagcacaacacacaagaggagagattttactgagaagtttaattggagatagtcattccccatccctgaaaaaaaaaaaaaaaagatacataaacaaaacaactcatatcctacctttagactgcattaatagaaacataatacctagaatgaaggagatgatagtttactttgcactatcaggtcacatcgggggtgttttgttcaattctggatgctacacactgaactgacttcaggaaaaatagaacagtgaataggctaaacagcatgtgatgtgagacataatttattgtgtctgattatcattataatcataaaaagaactaagtgccaagtgctttacatgcattttctcgtttagttctcacaacattttgcctatgaggcaagtactattattatccccatttcacaaaaagaaaataaaggctgagagaggccaggcaacttgcccaaagtcagagaggtgatggggggtgggcagccaggaatctcaacaaggcttctcttgttctagagctaacacacataggaaggggagatagagccgggtgcagtggctcatgtctgtaatcccagagctttgagagaccaaggccggaggatcacttgaggccaggtgttcaagaccagcctgggtgacatagcaagaccgccatctctacaaaaaaattaaaaattaaaaattagctgggtgtggtggcacatgcctgtagtcccaattactcaggaggcagaggtggaaggattgcttgagcccaggtgtttgaggctgcagtgagctataattgtgccactgcactccagcctgggtgacagaatgagacgttgtctgaaaaaaaagaggagaagacaaatattagaaagactaccacttggaaataggattggtgcatagtcatactgactataaaagggagcactaaaaccaaagaatgggaaaattggcccgttacgtggaaaaatgtacagtaattcttttaggtgtctcacacagatcccttcccaggcttttcaaccccatttcaaatcaaattgactatttccttgaacaagggcaattatattaattgcaaagagttttctgtttgccatctaccaaaggttacagctcaaacatttaaggtagtgtctttctgttggccacatttctctgtctctttctatttctgttcctattaactactgcacggatctgaataatgcaaatattaaagatgttagctttgactttacaaaatatatcagctataggtgcccttgaaagccaggacttgctccttcccttggtgccaccttgaaaccaggatgggaaatttgcaggtcaccctaggttttgaaaagaagcgatccatttccaagttgcaatctacttgaaataatctccccagttacgtggaagtaatttattccatatttactttctgctttggattatcaaatatctcttcctcttacccccgggggcagcatttgggattaaaaaacttctactacctgccctgctggggctgcattatttaactctttcatgcctatttaagagcaggcaaaatttgcagcaaatgataactgaagtccctactagccctaagatgtattattctacgttaactttatttgttttagatgtactctatttccaaaactgtttattatttttagcaacatttttttaacaacactgaggctgacctatataaagttaagcagctgaaagtaaaatatttaagtaacaagttgacccatgcaatgccaaactaaagagtagatgtattgtttattccagggtcagacgaaggtcaagtggtgctaaacctagaggtcccctcatttgggtcaagtctcactttccacatgaatggattgccaccaatgaaggcagccaggggactgttttgtttcaaattccctgtcctgggtgtagccctccaaatatcagtgcttgcttgttgaacttcttatggagaagaagaaaagtcttttaaaaataaatcttggaccctcacatctcagagccatgggcgagcctgacttgcttttgtttttaataatagactaccttttagagttgttttaggtttacaggaaagttaggcagaaagtatgaagagttcccatataccctcttcctaccctacccctactcccacagtttcctctattattaacatcttgcattgaacatgactcttttttttttttttttttttttttgagacaaggtcttgctatgttgcacaacctggacttgaactcctgggctcgactgatccacccaccacagcctacggagtagctgggactacaggagcaccccgtcaggcccgactgagcatgaccttttgacagagtagtccaggtttgctattcttaagttccctgaccttaagatggcaaagaatactgtaaggcccatccctgttccaaataggactcactcaatctgtagaccttaaccagcttctagggccaaggcattcctcctactaagaagcctttgtcacaacaacaggaacctgacccagacgcaacctcccctaaaaacaagccagacaagagagtgggcagggagcagacagcaggaacaggctctggcgagggcctgagaacagcaagtttcaacgaggtacttttgaagagattgttggctacattatcttatttaattaccgtggcataatccttacatggctaaactatttatcaaaaacaaggctgtgcaacaattcagcaaatgtcactgtgttgttattggtgaaagttgctcccacaaactgctctttcggggtgtgctgtgctaggaagagccttttccaggtgcctggccattcttctgcaccagtttttaattgctaatgaattaaactttccaaagagataagaataatgttgttttgtttgcgcacagattgcatgactaacaaggacgatataaataaaaccattccaagctttatctgtgggtggacaacagtgcctgtgttcaagtgaagcctgagatggctcccacacaagattaggttgttattgcggaagctgaggcttgcacactgttaaaagcccgagctaatatgttcgcttaagacattatgcctaattatgctatgtgtcagtaagggaacctgttccccaaacgttaaactatcctgaagcaccagtgtgggtctgagccaagtggactctgtaggattctgagctaactatgctccatggtgtttatgaaaatgggtaagatctgatcctggtgcattctctaccttcaggatgatatgtattcctacttggaccagtaactatcttaacaaatatatgtgaggagaaatgtttgtgcttttatttttggaaacttaccataaaaatctgcaaacatttcctataaaatgcagagttctctgtccatcaagttgtttgggggcactgaggaaggagatgtttatttatgagtttgtttccagttcaaaaaaggaatgccttcatgagcaggagaaatgactgaggtctggatttctgagtcatgatttgggcttggctcgtggttttaggagagttgaacatcctttagctaatgtttcttgtctctatgcgggtggggtgtgctatgataagaacactagccttgttttggctgaatgttgagtgcaagaatcctttgctgacctaagaccatctagaactgctagaaattcagaatggctagaaatgtatgtgttgtgtgtgcctttctctttgttccaaccctaaccttaattgtgtgtgtgtgtgtgtgcacgcacacgcggtcaagtcaagcagggtagaaatctgaggcactggtagcccactgggatgcctttgtctgggattcactcaccatcagtcaagaggcttcaaaaattaatttaatttgattaatgggagattgaaatcccacaccaaggccttaggaaatctcatggtgaattaagtcacatggatcatttcatacctcaaacttcctgtggcttccagggagaatccataatctccaggagttggtgaggcaatcattcacccctagacacatctggactctgactgcaacaggtagaatcttgactctgtccagccatccacatctctactcccagcctctttccatatattttccaaaatacttaaagtcaccctgaatgcccctcttagcacttaatgctcagtatcatcatttaagctcattttacaatttttcaatgtgtctagaagtgtcctcattatttcctaaaacaatatccttttccctgcaccccacatttcttcctagaggatgcccattctctcctctcccttccatcagagctctaaccaaagcccatggttgctccctactctctgacttcaattcctcattcttcctcattctcactttcactgatgcatgctctaatcacctcagttctcctagtctttcatcattctaacccactcataaatactatttgtatttgtttacacactcagtcaagaactttttactgtcatatctggctcaacatttttcctgcctctgtgtcaatttggttcccttttttgttctaaatgtatcatccactattcatcctttcatctaaatccatctttccatccatctacttcacaattatttatggagcacctaatgggctttatggactgctttaagcactgagaataagaaggtgaataggtggcagcccctattcccaaggagttcacaggggaagatggatgcacatacatcacatgtggttaattatctgggtgtgataaaggcaatgagagaggagcacagaggaccagtctagaccagggcaggggaaggtaatcagagcagtcagctcctcctccccagccaggctggtctttctgcaaaaccatcactcctcagttcatggcttcccatgccgtgtacctgaaatgccctttctatccaaatcttggctattttacaagatcagaggtattctactctacctctgggaacttttggacttattcatagcatccaatttaggaattctttgatacatgatgctttgccttctcaaataggttacggcttcgaatttaaggagagatcattgtgtctcagtacttttgtgttccttacactgtgctaccaaaaacactgaattaaaaaacaggacatggataattcattcctagattttcctgaccatcttaccttttctgccaacatgagtaacaccttatctatatgtagtaggcacttaataaaataaagacattgtgagacattggaaagaataagaacttcaaactcaagttcaaattctaattcaattactggctgtttggacttaggcaactttatcttttctgagcctcaggctccttaaatgcaaaatgaggactaataacacaaactttatttctatttaggggacgattaaatgaatctgtatatgtaaaatgcctagcactgtgctttgcatatattaaggaatcaaaatatgctagatcctgtccctccctctattcttcgtcccctctccatccccaacccttcatgccaggcaaaatttggcaagaagcaatagagacatttaaaactttaacacctgcatgcttttggttgcaaaacagtgcttaagcttttctcaaactcccaacataaagcctgggaaggacctagatttgttcatcacacccagcttgtcacagggaaaatcttggtgtatgtattactcagtcttatgtgggcataaatgtgataaaagttctgtgatctttgaattttatggctctcaaaaacatgtgacactctacattttttactgcccttcgtcagtcagctgattttgagacctagggaaacccctgtacgttcttcgacccacagaaagggttaaagattcctactacaaaaggactcagtgttctaactctaaatgtcttgggaacatggcctggaaaggctgagggccattgcattacacaattacctatttgctggagacagtatatttaataactaatcatctaatctaataatactgaagaatatcagactcaaaggtcaagtgtttaagattagggagaaagcagccttaaaagtacattttaaagagcctcacaggtcaacaagtcagccttagagcctgccatgcaaccaccacttccaggctgctaggggaatcagaaatgtcactatctttcaaacttagaatattgattatatccactctactcataggggctttattccatgacatctcttagttagcaatttaagaaaatgatttcatcctatataatgccagattagctcaatgacgaaaaatgttacactaggagctcttcgatacacacttgagagctcttacccaaaatgttattttccctctggactttcctgtgttgataagttctgtttgcttccaattgtggttcactcttgtggatctttttctcagagacctaagtgatcatcattcctagagatatttgtggtacaaattctttattttcaagttctgaaaacctcatactaaaaagtcaccctttatttctcacttttaaaagcctgaatgggcactcttcctcatctttcatgaagttaaagtcttgtcacaattcaaattccctagatgaatcccttaaagaatcactacacagtgctgactctccaatgtgcacacttgaccagcaggacgtgtatgtttatttcaaatatttgagtccttttgcttgatcttttcataagttggtctcacttcagtcccctgatggctttaaatcgtggtactttgctcacaatttctcagagtagaacatttttagagaaagatctagacatctctgctttttctaggaaaaataaaaacataaaaactaaaaaccccgcaactctcaggatagaccggattatgctgaggtaacaaattaaccctaaaatcccagtggatcatcaaaacaaaggtttctattttgtttcactacatgctcatcacaagttagtgagatgctctgctcctagggctactcaggcaccaggagcaactccaggtagttcctcagggacccaggctgaaggtgattacaccatctggtcatgtccctactgtagaagacaaagaggacctcatagcattcttctatgcctaggcccagaatgtacattgtcccacttcagtttatagcccattagctagtgcaagtcacaagtcccctaagtaccaggaaatgtggtcttttctgtgtgcagaaacaagagaagaacaaaaaaagtatgcaaacacactcacatcaccattgcctacattaagattttatgcttcaagaagagtgaagccaacagaaaaggctgaacataaaggaaatctctaagcctggacacccggtggatccagaataaccaaaacataattaaaatacttactgagcacttactgagtacttttctcaagattaatgcaaatttctattctgcctttaattccttgatttttaaaaatattttaagatttttgccaagcttttacattttaggttataaaagaatttccaaggcctggtatggtggctcatgcctgtaatcccaacactttgagaggccaagatgagaggatcacttgagcccaagagttcaagaccagcttgggcaacatagtgagatcccatctctacagaagataataaaatttaaaaattaggagggcatagtggcatgtgcctgtagtaccagctactcaggaggctgaggtgggaaggtcacttgagcccaggtggttgaggctgctgtgagctatgatggcaccactgcactccagcttgggcaatagggcaagaccctgtccaaaaaaaaaaaaaaaaaagaaaagaaaagaaaagaaaaaagaaatgatcttccaagaagaaaggttgatactaatttttaaatgtaaggtcaatcactacttggttcacattaaattttctagcaaatcttgtgttcctcatttgcaagatttgcttctgatttgctagatttgcttccggatttcccttggtttgcttctctttgttcagaagataaattcacactcaaagtagcacagggcctgacatagatgtaaatgctaagcatatataccaatgcttaggaataacaaataaatgagtgtgaaattagaagcatcactaccaagaatatttatacaaatatctagacttatactccatgctacaacaataaaatccaaaatcaatgtgtcttacctttcgcatacgatcattaatgccaaagggcagtactgatttcattaaaagaacaattagaaaagatgaagagagattttcctgttttcctccaattttgaatctgtcctccttttcccattttccccattttcacagattcttatgataaagttttcatttctcaaggagccaacgtcaccccagactcacacaagggaacacaactgtgttatcattgcttgtctgaaggaagggaagtcaccaatcctccttcaaacaggaaaccttgtggaaaataattgtgaatgtagagcacacctgagcagaaaaaaaatgctgaccagaactgtgcaataagtttcttccatgttggaagagtttgacttacaactcagccattctctgctgcttatataagagcaaagtcacgtcaaaaaagaagccaaaggaaacagaatgttctccattgcaggaatgactgaagtttcgccaattaaacttttccttaggcatgaacataagtaataacctaacatatcctgagtactactttgtgctatgcagcctgctaaacacactacatgcattaaggttattgaaagtggaagtaatgctcccagtatttgtgcaggataaaaagaaaatattaaattatttgtttttgtttattttgtaaccttattatttagtttacttttttgcattttattatttacatcatactgtatatagtatattggtacctatataaaataaatatatactcacacacacatatgttgagagcatacgaatagcagttgcagctcagtttatttttaatcaatgagaaaggattattattattattgttagttatcattattcctgtttgcagaaaaggaaactgaggcttaaagaggttaaaaggacttacccaaagtgtcaaagttggtaaatggcagagctggaattcaaagagtctgattccaaagtctatatagtccggcgtgatcattaaaggaattccttgtgttcaaagagcagtgcttgaaaaccaagctcatttgtgcctgcagaaatgccagcctctggggtagaagaaatgtcatactttgatcatcttccacactgaattaggaggaaaagcagaagaaaagaaactgagggtaccaatgccagacagtcactaggtagtaaatggaaaagaatttaaagaaagtgaaaatcaaaggaaaatatcacaacgtttggttgacaccctattcctcacccagccccttaatgtctttctacagaaatcagatttctggtgcaggcagttcattgtttgaacatgcagtaatggacacatccagattcctaacactggggagttcagagtcaatcaacatggattgagacacttacagcttcatcttttgctgattgagcactgaggggtgtgtatccccatgcggtccctaagagctacacccacgggagaaacattttatgttgttcaaaatacttggtgctatggttgttatcttcaattttcttaactagtaatgagtgatcctagtaagtgttaaaccaatatgcactaggctctctttaggatattcattacggaaggctttgaagctgagaaagaagtttagagtttagggaaaatttttaaaacaactctatattataggcattttaaaaaataagtgcaatggaattctttagaggtaaccaagtttctcaggatatctttgaggcagtgataaagatttaagtttttaaaatcactatcaaacccctttgtgcaacatttgcataaattctcaaacaatgggactgttttcatgtaaatttgttttcagggagattcctgctttctgaaggcagtgtaactgtagctgagttacataaagtgacattttattgcctcctgtggaagatgctttgcactaatgatctgaaatctgatgtctcaagctaggaattagatgatctgtggctcaaagtgtgaaaagagaaagtggggcctttatgttttagttaattacttctggctaaaatgtggggagcgctccctggaccttctgggactcctggaatccggaaacctgtctacaaaacctaaaggattgaagcagttgacctcatcacaggagtgaccacagggggaaaaaacagtgattcacaaatccaagcctgatttcagtcagaaatttttctgtgtttcataaatctgccttttttctctaactgcccttgccacctagcaagccaggaacagagagaccaaaaatcatcataaatatggaatatgcagtcggaaatgtgaaaaaagagcttgctacccagggagaacaaagctttcacccctctggggcttcactgtgaaaaagaaacaactctgcttgttttgtcttattttcccagatacttctatttgaaaaatatagtaaatcaattaatcaatttttctctccctactatccacgccccctcatttctccagttctctaattctctaattcctgagttgtctaattcctgagtactcctagggcagttcagcttactacaagagaattttttgtggctgttctcaaactccatattctgtttgcagagaatgctgttccttaattctgtttgagtttcaaagagaaaaagctcataccagtttagattacccacaatcctcaatgcatatcgaacaaaattgtcattcctaatggcaaagttcaggatataactgtgttagttaatttaatcatttaccatgaaataccaggtgtcttaatcttatatatagttcttaagttggctgcatatttttgtgcaattgaatactgaccctacatgaagaatacaagaattttgtttttaagtaaatgttgttagaaataaaatgtttctactggaaaaaaaaatatgttattagaagcactgtgaatttttctccaatgcttgaagagtgaccactccagcaagcctggcttatgttggtggcattctgccctgccactacctccagcacatccacagacctttatttttgttattttatgaccacatgcaggattctggcaccaaggactccatttggacttaggaaaagtagaagagcactctgaaaactggacgtcgggaattgatgaactggcatcgcaccccaacaacacactctgcttgtgggccttactctccagatacctgatgtattactggagaagcaaatgcaacaaggcaaagatgtcttcattttctgtcaaagcaaggcctcaactatggtgtcattgaggccctgaatctccgcagccagccagtcagaccccatcaacagctgcagcaagcagggctgaggaggggaatgggaggcgataggagccaatgagggctgagcccgcagctctgtgtctgactggagcagagagacagagaggccagggccagaggaaaccccagcagcaagggaaaaacagattgactctcagtgactcatttagctcctgggttggacagatctctcccctgctggcaatttggctctgcatcaatagttcgaataccaggctgaacagcttcaaataattagggggaaaaatctgcaaaactgctagccatccaattctttactctgtgctgaaagacacagtacaaatgacatctaggttattaaatatgaagtcactggatttgctgcccatttggtccaaaggcagaaaactggataaaactcaaatttataattcagtgtagatggcctgtttgtccttgaggcgatccatgaattttggctgggcaggcgctgtgaatgtggaagtaatgtcgtgggggaagggggatgaacaaggtttgttccccccgccccgccccgactcggcttacaccccctggggaaaaaaaaatgaaaatgtcaataaagactgtgaatgtgaagagaaatggaatctgagcccagagtttagtagctggcagtttaaactttatatactttaggccgacaggcgtctggatctcctgtactttatatccagcgtacaaaaactgaagcaacaggctcatttggtatcagtaaaggtcagttaaaattatagagacattttttggagcaaatctccagtcttgtatttgcatatttatgaactagagattaagataggccattccacttattagagcagtgctgctatagttaatagtctgtcagcatttccattataaaccccatttttcagtgtttagtatctcagctgttagaaatcacatcaggctgaaaagtggtcttcagcatctcaggccttggcagggtgagccggtggtggtggtggtgatggggcttgggaaaccaacaaagacatttaaatcaagccaactgtttttacattggatattaacagtaaatatgaaatcagagattttgaggggagttggtgaattcttctcctccctcaacacccccccaccaaattatctttcccctgtcttatccttgtcagtatcagggctttcactctctatttaaagggaagactctgggattttagggcaaagatccaaagttttggcttggcaaaatagttttcctcacttcactggaattgtgggggtaggggagagcatcagagtaaagcaaagatgttgaagacattcattcattcataaagaattggctcatgcaatcatggaggctggtaagtccaaaatctgcaggttaggtgggcaggctggagactcagggaagagctgatgttgcagtttgagtccaaaggcagtctgctggcagaatttcctcttcctcagtggagatcagccttttccttatgaccttcaactgattggatgaggtccattcacattatggcacataatattaaccatcacagaggctaagctgctttactcagtctatgatttaaatgttaatctcttctaaaaaatacctttgcagcaatatccagacatctttgaccaaatatctgggtaccagggcctagccaagtcgcacataaaattaaccattgcagggaccatgttttaaagatctcctatacatcaaatcctgggcttggccttggagacacaaaattaatgacacactccttgtcctcaagaaacttatgatctaccatcacactggtaccaagttttcacaataaaattacagactcaatagctggttccatgctttgctttctctttttggccacttgggatatcccctgcacagaggcacaattgtgagtgtgcttagctgcattctcaagagaaggcactgctatctagggactccttatcacataggaagacagcctgctctttccaaaccaaattcttgtaaattcactggacactaacctgtcaagtaactcagtgatattcaaagatcctttgggatttgaggagaaattggaaaaagagaaaagaggaagcagcttgctttctcaagtcattcattcaaaaaaaaaatgagtattggctcctgttatatggctcctcgatgtgttttagaaaccacacaaacacatcctcaactggacaaccatagagcaggttgaaaaattcctactctacctggcggagtttccagcccctctgcagaagtgcacacctatgcaaaaaccttcatcagaagagaaccttaagggatagtctgacagtagggaatcccaatgtgtataaccagtggtccttgctatctgactccgagagctacactgagtaatagaagcaactctccttgccctgtcttctaggtttctattatacttggagtaggtaagctttattttatttgctcaagatatgtcacacccctggacacacagaataaaaattcaaagtcctcctggaattcaagatgtgtcatacccctggacacacagaataaaaattaaaagtccgactagagaggcagagaatatcatcactgtatcactccattttactttattgaaaaccttaaaagtaaatataaaacaacaaattacggtgctgctattgttgcttgctgtctgggaaaaaaagaaatgttggataagaaggtcaaaatgtgccaattcaatgccctgagaatggtcacctaatcttctatcaagggatgtgacataccatctaaagaacggctgcccagccaggcgcagttggtcacatctgtaatcccaggactttggaaggctgaggcaggcagattccttgaactcaggagttcaagaccagactgggcaacatggtaaaaccccatctttaccaacaatacaaaaaaaaaaaaaaaagctgggcatggtggtgcgtgcctgtggccccagctacttgggaggctgaggtgggaggatcacctgagccccaagggtggaggttgcagtgacctgagattgcaccattgcactttagcctgggtgacagagtgagaccctgtctcaaaaataagtaaagaaagaatgactgccctcaatgcctaggagcttgactctgctttacttctgccctttcgattctctgtgaaatgaacaggacttatgtaattgctttcagcagcatctttgaattacaattacataataagacacacaccaggatgtgtgtaattgtgtaataacagcatgcctcactgtgctaggttggtggccaataaccacttagtcatgctattatattataagaacatatgccctcaaggcatgttgaaattattctggggatctctaaaggaaagctgactgatcaaaagagaaccccaacttaaaaagctataaaataaataatttttaaaaatctgatagtaatcccaacaagaaacaaaaaaattacacctaccctaaaaacaaacaaacaaaaaacctgtagtgtaaaatcaaaatcaaagtgttgtgtaatgattcacttacgtcaccacaggatttaagatgacagagtgttaataaggaaaaaacaagaagctggccagaagtcaggtgtcgtgatgccctcttcatagttggtcagcgtgaagactacagaggagttatgtctcaacccagaaagttctagcttctttggagcctactccttcccaagaaaatgacaccccaaaggctctataaactttccacactttgaacttttgtgttgttctcatagtcatcagatcaaaaaataatctcagaaatgtgagatcagacttttgcagttgaatctccccaatgatattttccttacagtgaaagtatgtgctaggataaattgcccacactttattcttacagcacaagatacatatatgttatatatatagtatgtgtacatacgtttcaatacctaatttttctgtatatgcaaactacatttccatctcttccactcttctaactcatttggcaggaaaaaaacctcatgcaacaaaaataaggcagtatgagatgaggggagaggtgggagagatacttttgcaatttataaaatattagtttgtcacttcttagataaggctgtatcaatacaagttataatatcgaggtaaacataaatgtatatgtgtaatatacttgtaattcacaattgatgttttgttttttccttatgcaattagaaccttaaaatatagaagttttgatcattactgtaatgggctgaattatatctcccctctcccctagattcatatgttgaagtcctaacgcccagtgcctgagaatataactgtatgaggagataaagtctttaaagaagtaataaattaagaggaggttattcaggtgggccctaatccaatatgactggtgatatggtttggctgtatatccacccaaatctcatcttgaattgtagctcccataattcccacatgttgtgggagggacctggtgagagataattgaattatggaggtggtttacctcataccattcttttttgttttgttttgtttttttgagatggagtctcactctgcctcccaggctggactgcagtggtgcaatcttagctggctgcaacctccacctcccgggttcaagcaattctcctgcctcagcctcccaagtagcagggattacatgcacgtgccaccacacccaggtaatttttgtgtttttgtagagatggagttccactatgttggccaggctggtcttgaactcctgacctcaagtgatccacacgtctctacctcccaaaatgttgggattataggcatgaaccaccatgcctggccctcatactgttcttgtggtagtgaataagtctcacaggatttgatagttttataaggggaaaccccttttgcttggctctcattatcttctcttgcctgctgccatccatgtaagacatgactttgctcttccttgcgctctgacatgatttgaggcctccccagccatgtggaactgtgagtccattgaacctctttcctttataaattacccagtctcaggtatgtcgttattagcagtgtgagaacagactaatacaactgatgtccttataagaagaggaaatttggacacaaacatgtacaaagggaagactgtgaagacccaggtggaagatggccatccacaagccaaggggaaatgccccagaggaaaccaaacctgcagacaccttgatcttggacttctagcctccaaagttgtgaggaaataaatgttgtttaagccacctagtctgtcgtagtttgttatggcagtatacatttattacattattatatcaactgcacatttattacatcaacaaacttttttttaaacaatgctgagtataagtaatgagaatataatggagaggaaaacaaggtccatgttgttttagggcttatagtccaccaaaaaataattttgacaggacatgcataggaaaggcagcaaatatagttgtgggttttaatccattacgtatgtggcatttccaaaataccatatgtaagctgattttaaatattttcagtgatcttaaaggacatcaactgagtatttcagtcaccttaacaaccaaaagtattcaatgattcaacaaatgacctgcaactaatgactcaatctaaacccaatctaaacctccattgagttaaatttgaggaagtacctacaaaattattgttacctctctgcagggtgctggactggctctcacccacttcaattatgcacatctcttcccaacttcatgttcagtcataccagatgagttgtttgaaatcagcacccttcacactgcccactgaaggctccacttcaagtctgccctcctctggagccttttgttaaatctttgccagcacaccattcgtcagggtgcacccccatcaacaagacagcttaaagacatttagaaagcaaaaccatgacagaaaatgtcaaaggggaagagaggaatatacaaatatggaaataaaataataaagtggaagattctgatgtattaagccagagcagcagttctcaaatgttatggcctatatccaaatcacccagagatgtagggtggggccagggaattgaatttctaacaagtttcctggctatcccactgcactggaccatcggtatggctttttctcctaacaccagttcgtctcctgtgcttaccacctggttgaggaggggtggaagtgcatggcaggtgtggctaatgccattggattggcagctcttggtaaaggaaatcgatggccatgtataaacaatgtttaagctgaagtccagtgaaatggtccctggggacccacaagctgctcacagccaggaaggcagcactgcccaatgttgcccccaccatggaagaaaaagcatgccaaacaccttcatctagccctgaaggtattttcactaggcctatgtagaaggtagtttggctaaaacagcttcagttggcatatgcagaaagacacaatcttagagccacagtgaattatttgtttggaaggcaggaccctattaagacactggatgttgccttatccatatctggatcaccacaatgcaaaccatgcccctggagacagaaatctacaagccacaaagacagggagaaagctaacatgacattactgggaaggtgagtatacactaattagatctcacaaaataaggatgatagaagaattccattgtgttcacatttcttaccctctgtaatgttgaagatctgaaatttggttgtaaatacattggtaacttttttgtccaaattacattcccaagaaacagataaaaactgaacacaggttgaagtttggctgttttataagtatgcagttactgaaagcactggtgataacactgtcagaagtgaaaaattatagatgattaataagaaattgttgaaagaaatggttcttgccaaacaaaacatcaatgagattgaaaacaattttcattgacaaaacatgtgcctgttgggcattccagaggagtgtgatgagaataaatttgactgaacctttaaaagagtttttacttgttgggtcagatctttctgctaaatccctcagtgtcaaaatgctgttttgcctttcctacctgctctgggcatactccgtcacaaactacgttgtgtgaatctgaggactgctttagaaatgagttcccaaattgctcaagaaatagttcaggctgtaattctgaaaagccttctgctcactcaggtcctgtggggggagtttagccaataaaggaaagaaagaaagaaagaaagaaagaaattaaactctttcaaaagcaaactttggaaccatgacaaacatggaagccatgtgtataccatgctgtcagcatttcctgaagaagctgtgtgtgggcttcagggagggctctgggatgataatctggaaatgatgaagaattcttttatgtattttattgtagtacaggtctaataaaagctaagtattataaatgttaatggtgcattaattgtaagttaaaacaataatttgatactatttttccaaccacaaattggcaaaaaaatttaaaagtgagaacatagggtttggtaatgaaataggaaaatgggtgaacactcaaatacagtttgtggaaatataaattgatagaacctttttcagggacaacttggcagtatctatcaagattccaaatatacctatcctatgaggaagcagaatgcatatgagttaaggacagactctggattcagagatcctggattccaatcctggctctaccaattagaaccatgagatctcaaacaagttgcttaacctctctgagcctaagtttatcatctgcaaaactgagataataatagtatctataactcatggggttgtcatgggaattttaaaagttgatatttgtaaagtgtttacactggtgcctagcatataggaagtgcctagaaccctaattcaaggaaaacattctataaaacttctagccaaatgtctaagttcaatacaacatggtttctcacaacatataaatggaaactaactctagaggtccaacactgagaaaatatgcaaataaatgctagttcatcagcgtgattgaatagtttatagccctttaaagaatgaggtaggctgggcgcggtggctcacgcctgtaatcccaacactttgtgaggccgaggcgggcggatcatgaggtcaggagattgagaccatcctggctaacacggtgaaaccctgtctctactaaaaaatagaaaaaattagccgggtgtggtggagggcgtctgtagtcccagctacttgtgaggctgaggtgaggcaggagaatggcgtgaacctgggaggcagagcttgcagtgagccaagattgtgccactgcactccagcctgggtgacaaagtgagactccgtctcaaaaaaaaaaaaaaaaaaaaagagtgaggtacagctctgtgtaccccaagaacaacatattgctgagtacaaaaacaaattgtaaaacagcatgttcagtagaatctcattattataaaagtgaagtttgtgtgtgtgtgtgtgtgtgtatgtgtacctgaaaagatatataccatacttaccagtgatcacctctgaggagtgagattagagcagcgaagagactttcaattcttactttatacacttctgtattgtttgaacctttgaaaatgaacttaaattactttttaattaaaaaagcttttaaatcactagtctgagcatagtttagatttaaataattattctttctctctctttttttttttaaagattcagattcatagccatgcgatgaatgctactgttatcattgacatagatgaccatcccggaaataagattgtatgaatagtccatttagttaaatgtttcggccacttagatctatgtgaatgtgagcataaaatgtggaaacacttaggaaataagctttcattgtatagtataatagggggtaatgagattcggtcaatctgtcagagatttaaacctacccgatcctaaagaaaaacaggcctaaaatatttcaaatgtgaggttatattaaaagccacagtttcaaactgtgaagctaaagaaatcagttgtttcagtttattgtctcagggaaagcacagtgtaatacctgaaggacttgaaagagaaccaaaaggaggggtagcattcccagcagctagcactttcatccaatgccagggctttcattggccaaattattttcaaagatactgcctgaccgaagcacttctgcaataaaagtatctctgtgttagtcaatggaatgggggaatgttaaaattgaaagaggcctttgagaccagctaggtcagtgtccacatttcatagaagaggacactgagttctggaaagatcacgggacttcgtaacaaaaacaaactacagctcaggtcaactgaccatcagtatagtatgccttctaatacactactgtcctcgcactttttgtattttaacgtaatggttttaaaatgcacatgggaaaaataaatataaactataatatagaacacaaaagctcccagagaagagtttacttcctattcttgtactccaagtcccagttactctcctcagatatgaccactgtgctcctcagatatgaccactgtgctttttgttttgttttggttttggtttttgagacgagtttcactctgttgcctaggctggagtgcagtggtgtgatcgtggctcactgcagcctcaacttcctggactcaagcgatcctcccaggtcagcctcctgcatagttgggagtacaggtgtgcaccactatgcccagctaattttttgtatatttttgtagagacaggatttcaccatgttgcccaggctggtcttgaactcctgggctcaagtgatctacccacttcggcctcccgaagtgctgggattatacctgtgagccactgtgcccagcctataactactgtcagcagttcctctgatagtctttcagagatgctctatgaacttctaagcaagtgtatatatgtgtgcatgcatgtgtgcagcatattatatatacagttgacccttgaacaacatgggtttgaactatgtgggtccacctatacatggattcttttccacctctgccacccacaagacaacaagaccaacccctcctcttcctcctcctcctcagcctattcaatgtaaagatgatgaggatgaaaacctttatgatgatccacttccacttaatgaatagtaaatgtattttctcttccttatggtttcttaataacatgttaacttactttaagaatattgtatataacacatataacacacaaaatatgtatgtgttaattgaccgtgtatgttatcagtaaggcttccaatccacagtaggctattgatttttaagttctgagggagtcaaaagtcatatgcaaatttgcaactgtgttgagggggtaggtgcccctaacgaccaattgttcaagggtcaactgtcctatcaagcttcttgtttatttctttgttttcacttgaatatatcatgcaaattattccttatcaatacatgttaatcttctctcattctttttaatggctgcacattatttcattacattatattacaatttatttcatcagtcccatctcaatagatatttagacctttttgtcttttgtattacaaacatgctgttatcaataaaaagtactcatatacacatctttaagcacctgtccaagtatgtgtggagtatacatcagataaattattagatgtggaatttagccaaagagtatatttaattttgataagcaatgccaaatttttctccaaaaaggtatattaatttacacttctacaaagaaaatatagtcattatttaagttttatttgtgatttttttcttcacttattaaatgataagttccttgaagaaagaaaccatagcttctacaacttgattccaatgcccatggccacacatatcatcattctttaacaaagattgaatgaccaaaactgtgctaaagactgaaatacaaaaatagatatatattatttcctatagtggtagactagttatctcagagtaacccctctgctgagaaaaagtaaaatgaaattgggaaatatattttttgaaaacccacaccttccaaaagcaccaaatagttaatcgaataagaaactgcccagtcaaaagctagaaaaaatgaagcccctatattaaaatctgtttggccctaatgagatttgcttatctcgaagaaataactgtgaaactgcatttgcttagggcaggtgggggtctttcagggcagaggaaacaagacttaaagctcagggtccaccttagcttaagactcagataaaccacctgccactgtaaggtagaacctagcaaggttatcacttcagggtaagggtaaaccagaattaaaccagtccttcaaaagacttgcagcctagcttctcatcatttggctcttttagggaacctgaagcctcgaacttagattaagatagtcctgcattagtagcatctctagaatcatggcagaaacaaattaaaatactctcttgtaagaggcactatcatcttatgtctcaaagtattcctaaaatacattgaatagcacacaaagaaaacaaaatgcataggaaacaaggtaccatgagcaagaaccagttaaaacaagaagatagtagaaacagaccaacaaagactgtttgtcatatattgggattattagataccaactataaaacaactatgcctaccaagccttaaaaaagaaaaaaaaaaaggaaaagaaagaaagaaaagaaaagcttcaaaatttcagaaagacactgagggggaaaagtgacataattttgaaaaggggaaatataatgacaaattatgaattaattgagtgagtttaagggcatattagacatagctgaagaaagaattattgaacagaaaaataagtcagaataaactttccatattacagcacaaagagacaaaaacagaaaatatagcagagaggataagagagagggaggacatcttgaaaaagtctaacatatatttaattgcagttttacaagagagagaaatggagcaaaggcaatatttaaatttttatggttaaatgactgagaattttggaggactgactcatagaacttaagaattccatgcaggataaagaaaaaagaaatctacaccaagattcaccctgagatattgcagaaaacaaaagaaaaagtgaaaaaatctttatagcgtccagaaaaaaaaattttaatttaagtttctaaagcacaaaaataaaaaccaaaggaaaaatgggaatatattctccatgttcttatagaaaataaaaactattatagaactttatagccagcaaaatattcttcaaccatgaaagtaaaatacaggcattttcagacaaacaagaattgagagaattcacaaccaactgacttaggctaaagggtcagagacacagaaaggattaagaattttaaaaatggtaaatatatgggtaaacataaatattgaccttaaaagctgtaatatgcatgtcttacagagtgttaaaatatacagaattaaaatgtatagcaactccatgttgccagctagaaactagggagaaagggaagttttgttaaattattctaaggtcctgacctcttgacttcaggtaatccacccacctcacccccatctctactaaaaatacaaaaattagctgggtgtggtggtgcacacctgtaatcccagctactcgggaagctgaggcaggagaatcgcttgaacctagtaggtggaggttgccatgagccgagatagcaccattgcactccagcctgggggataagagcaaatctccatcacaaaaaaaaaaaaaaaaaaaaaaaaattattctaaggtccttatactcattccagaaggacagtaaatgtactgattaacattagactttaggccaggcatggtagctcacacctgtaaacccagcactttgggaggccagggttcaggaggattgcttgagcctagaagtctgagaccagcctgggcaatatagcgagacctcgttgctacaaaaaataaacaaacaaaactagccaggtgtggtggtatgtgcctgtagttgcagctactggggaggctgaggtaggaggatcgtttaagctggggaagttgaggatgtagtgagctgtgattgcatcactgcaccccagtctgggccacaaagtgagaccctgtctttaaattaaaaagaaaaaaaagactttgctaaggaaagggtgactattgtgtgatttctagagccagagagccactgctcaaagaatagaaaaagagtacattattttcatatcaacagaaaaggaaaaaaatagatggtaagaaaaaataatcatttcaaaagaaaggcaagaaaggtgagaaaaagaaacatagatctggtggaccaaacaaaagcacaaaataagatggttgtttcttggccaggtgtggtggctcacgcctgtaatcccagcactctgggaggcccaggtgagcagatcacttgaggccaggagttcaagaccatcatggccaacacagggaaaccctgtctctactaaaaatacaaaaaattagctgcggctgggcacagtgggaggccaaggcaggcagatcacttgaggtcaggtgttcaagaccaacctggccaacatggtgaaaccccatctctactgggtcgtgttcattcttactctctgtcccactcaatatctcctcctggagcccctggggctgccaggtgcttatctgtcaggcgatgcccccagctgaggaataagggacccatgtcctcaggaggaaggagggtcacttgaggtaacgagcactttctgggtccgtggagaggacacatggaagacgctcagtgagtgtcgggggatgcgtagtccctgacacgtgccctgataacttcgagtatttaaactgatttcttcccactgatgtctcttttgcttctccatggattcccacatccccagtcaggactcacccacctggctccaacgctctcacctgctggctttcccaggagtccagagcactaaccaggctccaggcaggaggaaagaatgaatgccttttgtttcattctctagtgacttctccctgctgtctactagggcatttgtttctcaccatgtcttctctctctcaatagtcttatttttccaaaattttttccaatttcaatgggctagattgtaatgttagtgattataatgttaattcaacaccttccacatccctatgtaataatttcttccaatagatttttatgtataaatatatgcatttatgtcactgttatatacgttatgcatatttgcatgtatttttaataaaatgtagatatatgcaatgtacctatctgtatgatcatttcatcaatatcccatgtttagtcttcccaattcttttctctcatatgttcatttaacgttgattttgcttgatttttagaatctcctccttcccaaaacacagcctatatccagtgtgatttccttgcctttgccttatctacttggaagctatttgggtttattaatcctaaattttttgaatatgtttgccagttgggatcaccttttcctcctggcaatcttgtcattactgggtgatgcatgaaaaatcaacaatacagaaagtacccaaatgtctttcttggcttccctttaccccttggattttcttgttcaaggccgctttccttctctgatgatcctcttgggtggaagagaaagtcacagtaagatcatggatgacagtgaatgctgttgggtgtggtttcattttcagagctgggtttagagacttcccttggaatgaagaaccctcaccagctggaaggtgatgctattgaaggctcagctgacaacacacatgggcatcaagtcactggccacattcatgcctcaagtgtcctaaaaccgaagatgaccaaaagaaagctcccattcagcaagtggagactggcctgcagattccctggcctgcaagcttagagtacgaaggtaatcacatctatggctcttagctgcactcactccttatttctctctgtctgtgatgacagctccttctcccactgcttttttcttctgtatttgttctctccagcagctgctgtcacgtctgtctggtctaacctctgtgtcccatgggctgccaccctgccaggcccttctggtcctcatcacctgtttgctctctgaactctgctctgttcccactgctgctgtcctgagagtccttctcacagctgcaggagagcccagcctccttgtctccctccaagtgcatggtgtgagctgctaaacacagagttctttgcctggaattgcacggcttgagtaatttgcctttccttcctgcatcccaaactccattgcccctttctgctgggagcattgctttaatacgtcatttatacacagatttttctcttgggacagcttttgagcaacccaactaagtcaaactttaaccctcaccttgtacatgggaatgagaagtgttaaaaatgagcactaagaaccccaaatcaaaaactaaattagaacctgggtcacagaagagagttccctactagcctggagtcaggtgtgtcttcagctccagatgggcaaccttatgccaacgtggatgaagtttccagggactgtgcctgctcctcatggagtcacttagctgacattaactggagaacatttatgacattccaaaggaacctcagccgaaggtagatgcagagggcagggcaggactttgaacctgcatagaccacgaggtacattctcacctctctcctttttattcacatatctacttctacaagctcagttagaatctaaaacacaactcaggtgaatcttgaggacagagaaatacgagagcatttaatgaattaactttgagaaaagtgagtccaggggtcagctttatgtctacataagatgatagccaagaacctatctacaggacagactttgcctcagacaagcccaagtgagagatttaaccgaaattgtcagaagaaagactaaaatccatagagccacagagaatgaaggcaatcatgagagaaatgaggataggaaagaaaatgatgggaaatcaggttggttcattcattgtctctaaatcctgctaccatgtaataagcacctggtgagatttcaataaacatgaatgccttgaactgacatcttgagattctcacttaaatggtctggggtgtgatgtgagcatcagtacctttaaaaaacttccatgatattctaatatacaaccgaagatgacaaggaccactggtctactctgacctcaggttttcaacatggagatgaccacttgtgtggctactccacacaaaaggctgagcatccatcagacattgatgggatctgtattcacctctcaacagtagtatttgtagaatgtagaaaaaaataaaaaagaaaaacaagaaaataggtggattagacctatagtctctctacttaaagcacacttgcttaattttaaatacaagtaaaataagaaatagtcattatattgaaacccagtatacagaaaacaatacctcgtatattacacatattcaaatttagcattttctgttcaattttattttattgtattttatgttttgttttattttattttatttttaagacagagtctctctctgtcacccaggctggagtgcagtggcgcagtctcggctcactgcaacctccgtctcgcagcttcaacaattctcatgcctcagcctcctgagtagctgggattacaggtgcatgccaccacacttggctaatttttgtatttttttagtagaggcatggtttcaccatgttgggaaggctgatttcaaactcctggcctcaagtgatccatccaccttggcttcccaaagatctgggatttaggcatgagccgtcatgcccagctttcttttcaattttaaaataaatcctgcagtttacatttccacacactgattccagagcccatgaatgggttcagcactgcagtgtaaaaattctgctttgctcaattcttttcattcagccaaatcctcaaagagaactcgtagttctcactcaactagagagaatataataataagtaaaaactgaaactcggccgggcatggtggctcatgcctcttaattccaacactttgggaggccaaggagggtggatcatctgaggtcaggagttcgagaccagtctgaccaacatggcgaaaccctgtctccactaaaaatacaaaaattagccgggcgtgatggcacgtgcctgtaatcccagctacttgggaagctgaggcaggagaatcgcttgagcctggaagatagaggttacagtgagctgagatcgcaccactacactccagcctgggtgacagagcaagactctatctaaaaaaaaaaagaaataataataataataataataaaactgaaactcaggaagagatgatatatgaatacttttttatgctacccttgacgctggcataaaatactaaaaagaaatctttcccaacaaaccactttgggaaaaatataacagggagaggagaatgtaataaaacacaaactaatccttttcactttctacttcagagttttgtcgatcagatattgagaatatttctagaaatgccttaaggtgtaaccaggtatggaatcaacttcagggaattagggataataagttgggccatggttacaatcaccacccttcctttgtaattccatttgactctttccttttcctttttttctgatcctttttggaagaacacataatatttcttttgtcttttctcatttttaattttaccgacaaaacaagtagcagtgacatcatatttctttgtaaaagctcattcctatcctagccaaggtgacccagcaacctctagtgactgtcaagaactccagattggagaattgactctctcttctctccaacttattgaaagggacttcgtgcgtgggttctagtttcagggttgtcaatagcaagtcatgtggctttagttaagtcagccctgtggcatcactgctcctctgttgtaaaaggcagaactggatgtggatgtggtctgaggtccttcctgtatctcacctccagggttcttcccatggccctgcacacccttccctaagagacggggacatggagctgtaagggagtgggtttctctgtaaaaggtcctttccttctgcagccctctgtttctgagctttcatggttgatgctgagaacatcctcactgaggggtgtgaaaagccatcactctgctccagacagaaggaatcaggaggaaaggggctgatgtcaccggctgctggttgggcagagctagggtccctatatccttcacctcagctgactggaagttcaggggcatttacttttcacttgtggatggcacttgcctcttcactcagccttcggctcagccttcagctcatcctcctagcaggagctcagtttgcccctgggctatcaccacttagcagtccctctagactcagccatcagcaggacctgacaaagatgcccatttgatctttccttctctgtctcctacagatactaaatgctgctggaacaatgaaaagaaagaaaggatatcacaaaaagcattttcgtttgatgaaaaaaactaaaagagcaaagcaattgaaagctcaacacaacacaggagggatccatggctgaggattgtatttcagaaccactgactgctcttgacaattgttaacccacaattttggttagagaagccacagtccttcagcctccacttgatatcaacacttaggaagaccaaagccagatggacaaacagcattgagaggctttagccctgctcctctcacttccatcctgtagacaacagggaatttgccggtgcagaatatgaacaatgccatgttcttgctaaaaatgcttagcctgagtttcataggaggtaatcaccagacaactgcagaatgtagaacactgagcaggacaactgacctgtctccttcacacagtccatgtcaccatgaatcacacaacaaaaaggagaagagaccttttgggttcaaaaaaagtaaaaacataatgtagctacatttctttagttattttgaaccgaaagtatctcctcatctttttgttgttgtcatggatggtggtgacatggacttgtttgtagaggacaggtcagctgtctggctcaatgttctacattctgaagttgtctgaaaatgtcctcatgattaaattcagcctaaacgttttgccaggaacactgcagagtcactactgagagtttcctacctcagcccatctgcaggcagagaaggtccagtttgtccatcaccattatcgtgatactaggactgtcacttggttaaggaggaatctagaagacctgtcccttttagagacaccttacttataatgaagtatttgggaaagtggttttcaagagtataaatgtcctgtattctaatgatcatcctctaaacattttatcatttattaatcatccctgcctgtgtctattattatattcatatctctacactggaaattttctatttcagtttttactatatccttgtttttgctagtttctgttgttgaaaaaaaaatttcctgcctgggttttaatttttgtccacagttaactttaatccatacaactaaaattttttgtctatcactttggactggtgaattgtttttttacattcagtgttataatcttttattatgttgattggttttggcaggtaatgatacgaattaataaaaacatttttatttccgagtttattttctaaacacttccacattgtaggctatgtttaccatatgttgtagattgtatttactacatttctttgttctagttatttgtattctctgatagtgtgtgtgtttgtctgtgtatgcctttggcatttaggaagggttgtataggtcaagtttaatattgcactaaaatgttcttgatagttttttcccctttgaactggacacacttctaatatttggtttatacgttttaaattataattttcttttttctttttctttttttttgagatggagtctcgctctgtggcccaggctggagtgcagtggtgtgatctcggctcactgcaagctccgcctcccaggttcacgccattctgcctaagcctccagagtagctgtgactacaggcgccagccaccgcacacggctaattttttgtatttttagtagagacggggtttcaccatggtctggatctcctgacctcgtgatctgcctgccacggcctcccaaagtgctggattacaggcgtgagccatcgcccctggcctaaattataattttcaacatcaaatatttccatatgacaattacatgatttgttttctttttcctatcttctttacctgccacttctcataatagaagatagagatgaagatggagaggagagagagagagagaagagagacagagagagagagagagattgagactgattttaaggaattggctcatataattgtggaagcttggtgagaccaaatctgatgaggtaggcgagtaggctggagactcgggagagagttgcagttcaagtctaaagggaatctgctggcagaattcctccttgttagggggaggtcaggttttatactattaaggccttcacctgactagatgaggccaactcacactatggagtgtcatctgctttactcaaagtcggctgatttcaatgtctcatttcatcaaaaaacactttcacagaaacgtcagaataatatttgaccaaatatctgggcaccatggcccagccaaatttacacatgcaattaagcatccaacatataatattgaaagtgtagaaaatcaaagacaaaagaacatcttgagagaagctggagaaagaaaacaccttaccttagaagaacaaggatgagtactacattagacttctcttcataaaccatgcaagcaagaacagcatgcagctgacatatttagtattggaggaaaaagaactctgttaacctagaattctttagaattacccttcaaacgtgaaggagaaataaaagactttcttgacaaacaaaaattgagggaatttgtcaccagtaattttgtcttccatgaaaggttaaaagaagttcttcagaaagaagaaaaaaaccacaaagtttaaagacatatctacatgaaggaagcaagttagaggaggaataaatgaagttaaaaataaaatattttattatgtttattcttaattcatataaccgtctgtcaaaataagaaaaacagcaataattgattggatgattatatgttattaatacatcaaatgaatgagagtaatgttttaaaaggtggtaagaaaggaattaggaattttgtttttaaggtacctgcatgacccatgaagcatcataacattactttaagttgacttagattatttgtaagtatatatggcaagcaatagggtgaaaacaaaaacacaatttttcttttaagaaatggaatttgtattgtaagagagaagaaaaaaatgggatcatataacatgttcaattatagccagagaaggtagaaaaagagtaaaagacacaaaaggaaacaatgaagaaagtcaaaaaatagaaacagttacacatatggtacatattaatccaatgatatcaatagtcactttaaatgtgaatggtccaagtacaccaactaaaagacagagactggcagaatggaaaatgaggtccaattatatgtcatctacaacgaacctactttaaataagaagacacagagatattagaagtgaagagatggagaaagatatatcatacccatcgtaatcaaaagaaaattggagtagcagctgggcactgtggctcacacttgtaatcccagcactttgggaagccgaggcaggtggatcacttgaggtcagaagttcaagaccagcctgaccaacatggtgaaactccatctcttctaaaaatacaaaattagccggtcatggtggcgcatgcctttaatgccagctacttgggaggctgaggcaggagaatcgcttgaacctgggagacggatgttgcagtgagctgagattgcgccattgtactccagcctgggcaacaagagcgaaactcagtcaaaacaaaaaacaaaacaaaaacaaaagcaaacaaaccaacaaaaaaacaaaaaaactacagtagccacattaatttgagacagagctgacttcagagggaggaaaatcatggggataaagagagtctttatataatataaagaggtcacttctccaagaagatatgacaatccttaaatgatatgcacctaaagcatctaaatatcaggggcaaaagctgatagaacttcaaggacaaatagacagattcactattacagtgggaggcttcaggatcagtaactgacagatcagaaggcaggaaatcaataaagatgtagtgaaactggacaccaccatcagtcacctggatccaaccgactttttagattacttcatccaacaagagcagaatacatattctttttagggtcacatggagtgttcaccaagatccaccacattctggcccataaaacacacttcaacatatttaatgggatagaaatcataccaaatatgccctccattcaaattatggaactgaagtagaaatcaacaacagatagctgcaaaatcccaaaactggagatcagacaatacatttccagtaacacatgggtcaagaaaaagtctcagggcaaattacatattttgagctaaatgaaaataaacatacaacttataaaaaatttctgggtgcaggaaaattggtgcttagaaagaaattcatagtattcaatgcatatggtagcaaagaaaaaggatctacaatcaataatctgaacttacactttaggaaactcaaaaaacaagaaaaaattaaatccaaagtaagtggaaagcaagaaacaataaaaattagaggagaaatcaaggaaattgaaaaccagaaatcaatagagaaaaatcaacaaaaagaaaatgtagttctttaaaataatcaataaaactgataaacatccagctggtgaaccaagaaacaatgagagaagatacaaattacaaataacaaaaagaaaagaaggtcctcactactgatctcatggatattaaaaggataacagatgaagattatcaacaattctccgctcacatatttgataacttgatgaattggaccaagttcttgaaagacacagtctaccaaaactcacacaaggagaaatatataacctaaatagatctctatttattaatgaaattgaatcaatgattaacaaccttccagaacaaagcaccaggtctagatggttttactaccaaacatttaatgaagaaatgataccaattatctctagaaaatggaagccgaaggaacacgtcttatctctggtctaggaggcactttactagcaaaaccagacaaatggttttgaaccaggatattgaagtagcctgcactgctgaccagctcctgaaactcagccctggaaaaactgtagaagcaagaaggaaacatggcttacgggacctgtgaaaaatggtaaatctcccttagagaccaaggcggttttgaaccggtgtgtgtggaaggttgatgttcacaggtaggagagagagaacgacatagagaaaagtattttcggttctgctcttgcttctgactcccttgctatgggccaactgcggctcttaccccttcacgaaagagatttgtcagcggctgtttattttttgagacggagtgtcgctctgtggccaggctggagtgcagtggtgcgatctcggctcactgcaacctccgcctcccgggttccagcgattctccttcctcagcctcccgagtagctgggactacaggcgcgcaccaccacgcccagctaattttttgtatttttggtagggatggggtttcaccatgttgaccaggatggtctggatctcctgaccttgcgatccgcccgcctcggcctcccaaagtgctgggattacaggggtgatccaccacgccccgccatcagcggatcttaatccaccagtgacgcagctgcgatgcgactcctggacacaatataagcttccctgaggaaaagagtagatgaaaacaggggaggacaaaccagatgatcccggggctttccttttccagctttcctccgcaaatctccagaggtaatgattgtcatggcctctccagcacgatgcttaaagagacgtattacaaagaatcccctagatagaagatttgcttggtggagtataaaacaggggtaatcgaaatgagttttggggacgtgctgctctccacttggggcccatccttcattttgccgataccaccaaagactgggccttcctcgacaggaagatccgaggtccctctctgcagctcccctcatctgcgtgcgggttccttcccacacgcctcccctgtccctgggcccccgtacccactgccccttccccactgcgtgtgtctgtccgaccccacagcttctctcctttcttgagcctcactccaccgcgatacgtggtctgtccaaggtccagtcagtgaaatcagtgtccaggtgactgtgtatttcagggatccgccagaagagacaataaacgtcccgtcggttttagggccaaatatgcaaacgcagagaccaaccagacacactagctgcttcaaagacagtctctgcgaagtccttgcttagagaaattccactccagaaggaactggaaagctatacagtagttcccttttccttctgtttattattgcggctgtgacctgcctgagtatacacagttatggtaaataaatgtaaaaaccgcattgtgcggaaactgcacgctgcaccaaccaggagttgaacacggatctcgtgcatgggaggcaggaattccaccactaaaaccactgacgcctcctgctagcaaaaactgcggcctttacatggaaaaaggtaagatcgggacatgggaagaggagtcaagatttttaccgtgttctctttggaacatgtaattaacaaaaaggacacccagggcaaaggctcacattagagatttgcatcaggcaacaccagaaagttatggcttcacattaaaagagctgatttgaaaaagacttattctgaaatagactctgtacaactggataacaaacctctgtaagaaaacaccagaaattcactcagtttcttgtctccggtgctgtatccaacgtgaacctgtggaaagttcttgccttgcttcttgataccttctctttgccttcccatcgcctggggccttccaaacccttcctcccaaccttgacacgaacatcagtactttccccaaaaaggccttcagaacccagggaccctggtttggaaagctggactcttgggattgtgcctgggatagtcccggagacctgggtaataattgagcttctctcctcatgtacctatttcaaattcctggaaaatgccagggatcagatcttgcttttaacttcttatgccttacagagaccaaaacaagagcgaagaaacggacatttcactccaagatgtcttcccttcacctcgccctcgtcggccacccaaggaggccagttcagggaaaaacaattccattcgattccattctattctagttagatgctaggatattactcctctagctaatgtaaagcgttcttttgccatttccctttgtctgatatccatgttttcattctcattcttttgtttacaataagcctggtacagatttgcaccactcttttttgttgttgttgtttgttttcttttctttttaaatgttttatttccaatttttactttaatttcaggggtacacgtgcaggatgtgcaggtttgttccatagataaacctgtgccatggtggtttgctgcacagatcatcccaccacccaggtactaatcccagcatccattagctcctctttctgatgctctccctcttcccagccctaccctctggcaggctcgagtgtgtgttgtccccacccccactctatctgtccatgtattctcatcattcagctcccacttataagtgagaacacagagggtcatgatgatgccactcctccaaggatttcaggcttcccagacgcctagttttcagtctagttcttctgtgagatcttacacttggggagctacacgttctcgcgtttggggctctttcaggttctatctccattttcccctcaattcctccccattctgctacaataacaaaacaattctcacctccggaagatcccgcctctgcctccgcacgagcctttcaggaggtctgaatgtctggtccaccgctccccggcttctttccccgcttttgcttttcccttcccccgctcccgccctcccgcctcacgacccgaccaccgcccagctgagcccccgcggctccactgcgcagaaggtgcactggaggccctgcccgttgcccgccccgcggggtgccgagaagtcaacctgaataaacgccttgtaaaaagaacttcctaatggaaaaaatatcttatgatttccattctcaacgctcttcagaggactaaaagataaaggccacgatggattcattcaacaagtcctaatcctgcgccctggtgtgtgccagaccctgctccccgcgaggggatccacgagcgaccctcaccactatccctgccctggtggaccctccgtgcgggacacagcatccgaagatggcagcggaagctcctcagcgccccgaaagcgactgggcagggggcacaggctccctcactgggtgaaggccgcacaaagaaccggaagagccatccgggtagctcacccggcgttcagcttcccttgggccccctggctgctcgggcccggatcgcggaccggggcgtttccggggatttctgaagcggacgaggggcagggcgggcgaaggccattcggctctccttctggctccagaatctcccaacccgcaggtgtgcagtgtgaccagcgcgactcaccgctctaatcgctccgattttccaaggccttgctcagtagtcctgccaggcgggctctgaggctggaagggattggggagttcggtgagtgcgccctgcctatagcgcccagtggaatcgctagtacctgtctctgtggcgcaatcggtcagagcgttcggctattaaccgaacggtgagtagttcaagaccacccagggacgcctgttctagcttttaaagcattcatgtattatcatcactagagaatctccccctattcttcccatagtcctaagtccgaaaggttggttccaggccagccagggatatgcccatttcaggaaggtttttctcttctcaggattctagtcacagttaacagggatccctatcaagagccaccccactcagagatccaattctgacagaccatctcctgaaatgtcaggttgtcttgtgcctgagtgcaagaatcagagaccaaacaagtcacttctggtgcgataaaatcctcatgcctgccccttataggcttggatggattatagaccagcttccatttttttcatttttaataggaggcctagagaggtgtcctatccccaggatgggcctggatttagtgattgctcaatcaataatgcgaccagtggaatcattgatcatcataataatcctctccatcatttttgaaaacagcatttcccccctcagttggtacatgatttacttaacccttttcaaaatgtgtttgaagagattggcttcatgattttaggactacaaagaatcttgaaaccatcattcttgtacatatatctttgaccactgatatttctatagtgtagagaactagaggtgccactgctacattacaggctttttaatttttatttttagtttttatgacagggtctcattctgtctctcaggctggagcacagtggcccaaccatgtctcatggcagcctcgtcttcccaggctcaagtgatcctcccatctctcagccttcccagtagctgggattagaggcgcgggccatggtgccctgctaaattttgtatgttctgtagagaaggggtttcaacatgttgcgcaggctggtctccaaactcctgggctcaagcagctccgaggcctcccaaagtgccaagatttacaggcatgagccactgcaatggaccttacataatgcctctaacttcagcacatttagcacatttatcctctgcacgagcgataccaaatcatattccaatttatttctcaactctcatactgcccctttcttcatttacttgctggcacaacaaactgtctgccaccctacccacccccccacccccactttattttagactaggtctcactctgtcatccaggatggagtacagtggcttgatctcagctcactacaacctccaccccctgggctctagtgatcctcccacctcagcctccagagtagctggatctataggcatgcaccaccgcattcaccatttttttttttaagagatagggtcttgctatgtcgccgaggttggtctccaacccctgggctcaggagatccatctgcctcggcctcccaaagtgctgggatttcaggcatgagccaccgtgtttgccatgtgcccatgatattctaataaggggacaggttccctcccggcttaactaaggggacaatacaacagaaggacatggtggacattacacacagatattctgttgcataggatggacagctaaacttctaaggcattttatgtttattttattttattttatttttcgcgacaaggtcttcctctgttgtccaggctgcagtgcagtgtcatgatcatagttcactgtagcctcaaaatcctgggctcaagtgatcctcctgcctcagccttccaagtagctgcaactatgggtatgcaccatcataggtggctattaaaaaatgataataattctgtagagatgtgatttcactatcttgcccaggctggtctccaactcctgagctcaagtgatcctcctacctcagcctcccaaagttttgtgctgagattaccggcatgagccaccatggtcagccctgtttctttttaaaatttatttattttgggacagggcctcactctgtcacccaggctggagtgtagtggcatgatgacggctcactgcagcctcaacctccctgggctcaggtgatcctcccacctcagcctcctgagtagctgggactagcagcatacactatcatgcctggctaatttttgtatttttttgtagagatggagtttcatcacattgaccaggctgctctccagctgagctcaagcaatgcacctgccttagcctcctaaagtgctggtattacagtcgtgagtcactgtgcctggcttgtcattgtttcctgtggtgaccaagtcacatgggtccagagaagacagatcacagtgacttctttgatagctttctgccaagtcgcttatccaaagaaagcaaaatcacaatggtcccagatatttttttctcctcccctttcctcttttccttgtaaatcttgattttacttttatttgctgaaaacaatctaatgccagttctcccttctatattaatggagaatgagcatgcaaataagtgtctctatatgattccttgatagatttctttcagaggctatgtctataaaaattagtccatctgagacccatcattggagccaacagaatccggcacctaacaggcccctggtgcagacctggatctttagagctattggctcttgttcccgcagttcttctgttttcatgagcagaaactgagcaattttgctttaaaatactaagtatggtcattggacaagtccttcccttctctctctctctctctctcatgtttgcatcattgttttctgccatcagtggcatcagtgtagatttctggtaaatgttatggagtgaatttctcaggacactctctgttgggtggtgtttggcaagaatccatccgtttggtgatacctgacagctaatctagtctgtgagtcttttttgattgtttattcattgtcctgaggataattgtatttcctgatatttgagactgcagcaaatgggaagttgctcatatctcatctttccaatgtttggtaaaaattttatgggcccagtagctgtcaatatctgcaagagtggcatctctattataaagatgatcttactactcaatgcccctcacccccaaccaaatttcattccgtaggagctcttggccgtaacaaattaatagacctaaaggagatcttagcacaggaagaaaactgaatctgcagcatgtaaggaacagttttctttgattcatatattcaggtttctaactagctgaaaaattcaaatatatgccctttaaggatgaagtttaaatcacactacagaaaggagaaaaaaagagtgatatgatcacaagtaagcaatggaatcagcaatttgagcacttctcacaactacacaaatcaaatttaacaatctctagaacagtaaggaagttcagcccttaatgaaaatggatgaaaagaaattattcattcacttttatatgcctggaaggagaatgtcctgccagactcaaaaggggatcaaagaattactcagattttcagcagtgagggttttccaaggatctaatgatgttaatttttcagtttgtttccctcactcataagcattgttaatagacacaattgcctctgttttcaccttaaatgatgttacataacccaattatttgcttttgaatgccccctggtttggtggaaggaatttttctaatgtataaatatattttcttatgaaaccaattggcatactctttcagtggagtgaatagataaattaagtctctaaaactttaaagaaattactgcctgattatctgaagtacagtaataatcacatatataaaattaaaataagaaaattaagcagggtgtggcagctcacagctgtaatctagcactttaggcagctgaggagggaagatcgattgaggccaggggttccataccagcctgagcaacatagtgagactcctgtctctacaaatttttaaaaattagctaattaggccaggcgcagtggctcatgcctgtaatcccagcactctgcgatgccaaggtgggtggatcacctgaggtcagggattccaaaccagcctgaccaacatagcgaaaccccatctctactaaaaatacaaaattagctgggtctggtggcacatgcctgtaatcccagctacttgggaggctgaggcaggagagtcgcttgaacctgggaggcagaggttgtagtgagccgaaatcgcatcattgcactctagcctgggcaacaaaaacgaaactcaggctcaatagtaataataataataataacaataatgcaaggatgtaatagtcccttcccaaaactaacccctgaggagctaagggatgtatgcacacaagtaaccgtgttctattcaggtgaccttaccaaagagaaagaagtttcaaagcccccttgggccctcactgctgcccagatgtctgggagtgtcagccacctcttgacctcaatcccctgcttcttacccctttccctaacatacaagaagccagaaatttttattaacttgagatgtttctttaggacattagttcaccatcttcttggtttactagccctctgaaataaagtcaccttccctgccccaacaccttgtgtctcctgacttcttggctgtcatgcagcaagtagggtgagatttggactcagttacttactaattcagtaggtaatatctttaaaaggagataattctagaaactaggagactgaattattccacttacaatttcttcgtaaatatatttagatgtcatctaatacatgatgccatcatcctctattaaatgtcagctcaatgtataatttcaagatatatagttaattttaaaatccatgaccgatattaatgattatatggagttaataatggagttaataaataattttgataataataatagagttaataaaaaataataaatttcaattgccttaaaattagttaataaataataataaataattttgattgccttaagattctctctctatattactttacttggagaatagtgttgcttgttgagttcacaacatatatatgtgtgtatatatatatgtgtgtgtgtatatatatacatatacacacacacacacacacacacacacacatatatatatatatacattttttttctgtttttgagacagagtctcactctgtcaccaaggctggactgcagtggtgcaatgatagctcactgaaacttcagcctccagagctcagatgatcctcctgcctcagtctcccaagtagctgagactataggttccccccaccacacctggctaatttttgtatttttagtagaaatggggtttcaccattttggccaggctgatctcaaacccctgacctcaagtgatccgtccacctcatccttccaaagtgctagaattacaggcatgagccacctcgcctggccctacgtattgaatttttttacgtggcattagcttttaaatcaaagctaccaccaaaagccagctttgcaaagagagtatatcactgagaaccacgtacaacatgtaacgctggtgagttttaattatacctcagtaaacttgacttaaaaaaaaagacattcccagattttggcacaacggaagcgttataatcttctattcatttctggcaagagtataaataagttcaaaaactttggaaaattgtttgcctgtatattctagtggtaaaacacacatacatatatgctatgacccagaaattcaacttttctaccccatagacttgtgctttccaatatgatagccacaaaccacgggtagctattgaacacttgaaatcttgctagtgtcacatggggtaatgataataccttaaatatatttagttgaatatatattataaaaaataatttcacctctttctttttactttttaaaacatgtctactaatacatttaaaagtacgtatatgcctggcattatatttctattggaatttctatttctagagaaacgtgaatatggtttaccaaagacatgtaaaacaaatacatatttattcaaaatattcctaaactataaagaattcaaatgtctgaggaaagaaaagaaattttatgtgaggaaagtgagtgctttcaaattaacaagcccagagttaggcattaaaatgagacagcaacaacgtcttatgtccctgttttgaagccgtgtattcatctattaaaacagcttgctatcatcacaagtggctataaagcaacctaaacatgctgcactggacaccatctctcactccctgtagctgaacaatgtatagctaatcattaatcaatgttatttctgtaaacttcagggagttcctgacaggcaattttgtaccagccaactccccgtctccctttttggtctttagaaacctgcttgtaacaaagggcaaatggagcccacatccaagattgcttggatctgagtcttccaggcaagtgtcctcacattggctcaaacaaactttttaaatcatgtttgtgcttaagccccttccttctaggtcgacgtttttggcccagggagcagaatgcagagcgactcatctctgaccatctgactgtcctctcaaaggcctccagggtggctacatagtagtaagaatttgattggtgagatcagtttgcagtccaggaagagacagtctccggtgtgtgtctttgaagaggtgctttctcttcagagagagagagagagagggcaggttggtttttgtgcctcacacggtgtgtatcacacaatggagttatacatattcagcaggtttggagaaacgccatttctgaggggtgttgagctcatgtgcaacgggtaaacatatatgtaacgtgcaccccatcttcacattgggaagagattttagcattaaaattagatggaaattggctctttatgtcaaaaggtgaactataggacatgaagtcggtttgtgtgcagtccctgtaacatggctgaaactggcttgaggtctgcagttgcttatcaggaaagaatggaagggcactcctctgtcccatcagaggtctggtgatctgggttgtaaatccagttgagaattgctgggaagattttgacaatttgcctgctagctcctattgttaaggagtttagcaagagtgtggtttttcttctagccacagaaatttaggaagttgctatgccagtccagccctgaatccttgacccgtaggtaactcttgttttcttaaccttagagtctgtcttagtctacaaggtgacatctatttttgtctctcagaccacattcctcctggactaggtgcctggccagctttgaaatcctcacgttctgactcagagaaacagatgggcagtaagtggtgaatcctcctgaaatctggaccttcccactctttggttgaaggcctggagtttgcttgagttgtcctttccagccttccctttctataatggaggttttctgtctttaccctccagttaagagacttgagtttcagggggaaaaaactgccctttccacctctgcctcaggacagaaagtttgggtcacagtcaggcaaaggactgtgtggaaagcttctgccttttctgcctctgtccctcatcaggaaggtctgggtcaagatattggcaggtaggcaccggtggttttgttttctgtagcatgcttttatgaaagtttgaacttaggttttcacttgtgactaattcttgttagtttttttttttttccttgagatggagttttgctcttgttgcccagggtggagtgcaatggcgggatctcggctcaccgcaacctccgcctcctaggttcaagtgattctcctgcctcagcctcccaagtagctggttttacaaacgtgccaccacgcccaactaattttgtgtttttagtagatacagggtttctccatgttgttcaggctggtctcaaactcctgacctcaggtgatctgcccacctcggcctcccaaagggctgagattacaggcgtaagccaatgtgcccggcccctgttagttcttacctggaaaatgcacggaggtactttctccagccctgaagaaaagaagtgatctgctcccgatgaccctttcaggggctacaagtgaccagggacgctgcagaggtgtcacggtcactactcaccatgtgaaggcggcctcgtagagcattccccatcagaagaacgtctttatgaatcccctttcctgctcttatgggagggtatatgagcgatgggtcccccagagcagatgcactctgtggccacctggtggttagaaacagtgggagccactgagacagtgatacacaactccggtgatatctgtaggagtgactacataagcaggacactgtgacccaaaacacatcccagattttggtcatctttgcaaagctcctgaattatgggaaatcaagcttcaaaatctgagcatactttgaagaaacaaccgcgtttagaaccaccagctgagtttctgtataacagttatgaagcatcctcttgtaaatatccaagaaacctgacccacctaaccagaaaaactcataagtagaatggagaaaatggggatcttttgaaatgactaaaataatttattagggcacacaattggaaaaatttggttttagaatcaggcaaattgaatgggagacttacttccaatgatacctagaaatttctaaaagaactactgagaaaattgcctccattgaggatttaaactggggatatctgatgctttttctgaattgagaaatattgaggaggcttcgtctctttcgcctccaactcctccttttcctcctgcccctgcacctgcatagtctcccttacctgagccctcctgtcctgccttgcctcttcttccatcaccatcacctgaggaaagtccccagggctctggccccttccctgaaagttctgttctggcagcccctttcaaggtaaaacccacaggaagaggggagcctgctattgtgtatactgcttcaccataatgtgaattaagaatattgtaaaagacttcccttttctaaattgaaatacattttcctcttctctttctaaagcaggctctgctttagatttagaagtagattggaggagaatttagcaatgcacttaaaaggccaaataaatctgtcattgatattttaaatggatgaaaataatttatttatttatttattgaaacaggttctcactctgtcacccacgctggagtgcagtggctccatcatggcccaccacagcctcaaacttctgggctctagcaatcctcccacctcagcctccgagtagatgaggccacaggtgcatgccaccacacctggctaattcttcaactttttatagagaggaggtctcactttggtttccaggctggtcttgaactcctgggctcagtcaatcctcccgcgtcagcctaatatttacactgaccacggagatgcatttggagaaggtggtgattttggaatgctttagaagcaacctaggtttcttatttcaccaggtcaacccatcaaaaatgaccaataagtctctgaactcttaggagcaatttgaaaacccaaatctttggccatcatcaaaattccttgtcattcaaaattaggtactctggagagcaaggacaaccattttgctgatgctgcagctaagaatgcagctctgaaggtgacaagagacacagaacttctctaaatgaccttgctgacttatgacccattgaaaacgttattagaagaagcacacgtgggatctcccaagcagaagatagatctctggcaagataaagggaacaagtttttcttcagaaacaggcgtatggtatgggcccaatgatacactgatctaccccttaggcttcaattaccctttttaaagtagttcataagctgactcattggaattcagactaaatgatagcatggggaaagcagtgctattgaaaaccatcgcctatgattgcacaagaggtttattcttgtagtactatctgttctgtcccaaacataatcctggaaaaccccttcatgggtcacagggacattttaactttaggaccctttgagacatggcagttagactttatccagctgtctccatctcagggtcacagatactttctggtgctaatttatatgtgctctcactggggtgaagcatttccatactgatgagccacagcccaagtagcaggtagactgtgattagaaaaaaatcattcctcatggggaatgccatctgatctacatagcaaccgaggaacacactttatcaggcaggtagctggatccatttgtaatgtttagcctatgtcccaacattcccattgtgcctgtcacccctaatcctctggactagtgcaactcaataatgatacaataaaaactcaattgacaaagataacagaagtttttaaccttccctggccaaagatcccccactgtttctggaaaacttccactccctccctttgaaataataacaggaagacccatgcagtggttagatgaaggggcttatgaacctgcacttcttaaaggtaacattctccattattgctaagttctcacaaaacttcttaccaagagctccaaattaataaaatattcctttcataatgagctgctgagggatgaaaatataaaaaattatgcctataaactggagacaacatcaaatactggaaacaacatcaaataaaatattccctccaagtccactggagagcaccacgtaggtattattaatattattattattattttttgagatggggtctcactctgttgcccaggccagaatgcagtggtgtgattataactcactgtagcctttacctcctgggatcaagccatcttcctccctcagtctcccaactagctgggaccagaggtgcgggccactgcacctggctcacatcaggtattatttcccaatctctgtggcagtaaacataagggcattgacacacagattcatgtttctcatatctaaaaggcaaccctaccacagtggacatctgtcagtggaggttttcacttaaaggtgacctgcaatcttcctaaccaagatggcgagtagctgacatctgttatggtacaatttcgcccaacataccggcctgtataagcagttattcacaattccagtgcttactgcaactgaaagagttggtctctttttctattgactggaatacatacactgttagggctcctttaagttgtaaattcctcctgattgcactgacaatgcaaatcagggtcacatcaagcaaaacctgtttatcgaatctgtctgactcatcctaaccttcctgccccatgtttcagtttaacccatcacaattgtacgtcaaaataactgcctgtaatcccagcactttaggaggccaaggcaggaggatcacttgagcccaggagtttgagactagcctgggcaaagtggtgaaaccctgtctctacaaaatatacaaaaattagctgggcatggtggtgcccacttttagtcccagctactcaggagtatgaggtgagaggatgactggagcccaggagttcgagcctgcagtgaattctgatgacaccactgcactccggactgggcaaaagagtgagaccctgtctcagaaagtaaataaataagctgggcatggtggtggtgtgtccctgtaactccagcacttgggaagctgaggtaggatgattcattgagccctgaaggtcaagaggtcaagactgtactggcctgtgatcttgtcacagcactccagtgtgggcaacagtgagaccgtggctgaaaaggaacaaaaatccgaaacaaaaccaaccaaacaaaaaatgttgcctcactctgaaatagcagtggtaaacaccatgatgctattggaaagttaagagaaaaacactccctcctgcaatcaggatccaacctgccctcttgctctaacatgtctgacccatagtttaaatgccgaaagctgatgtacccaaattatactacacttacctgttgtgcaccagcatttattttgtctctggaggagatcaccatccatggcccttaaatgtctgaaggcatggaatgatgaagtgcaatgtcttttaggatatttggtcaccgctatacatatatagctctgaagaaatccaacattggatgagtggggaggccgaggcgggtggatcacctctggtcaggggttcgagatcagcctggccaactttgtgaaaccccgtctctactgaaaatacaaaaattatctgcatatggtggtgttcacatgtactcccagctactcaagaggctgaggtaggagaatcacttgaacccaggaggcagatgttgcagtgagccaagatcatgccactgggcttcagcctaggagacagagtgagactccatcttaaaaaaaaaaaaaacaacaaccaaccaaacaaacaaaaaattggatgagtgtcctcaagcttttcactaggcatgcccaccactctattttagtaatagatggagatcctgttgggggaaaatttgctaatcatctgcctggccattaagaaataactccaaacattttcaggggagcatgcttttgctttgatgggatgttgctttccatggttagaaatccttctttagccttagttaacattgctgataaaaactgggcatggtggctctggcctataatcccagtgattcagaggctgaggtggaaggatcacttaaacccaggagttccaggctgtagtgagctatgacagtgacagtgcactccagcctgggcgacagagccactcttcctctttgaaagaaaaataaagagtccaggcttgggggcctatgcttgtaatcccagcactttgaggggctcaggtgggaggattgtttgagcgtaggaatttgggaccatcctgagcaagatagtgagaccctgtctctaaacaaacaaacaaaacaaacaaacacaaaccaaaattagccaggcatagtggtgcatgtctgtagtcccagctacttgggaggctgaggtgggaggattgcttgagagaaggaggttgaggctgcattgagctgagactgcaccactgaaatctagcctgggcaacataccaagaccatgtcttaaaaaaaaaaaaaagaaagaaagaaagaaagaaagacaaaagaaagaaagaaatattgctgataaaactgtagcctctttcacagctcaaaaaaaagctattcattcactggctaaggttgtactagataattgcatcactttagatgacaaatattttcaaagacactattagccttatttaaaaatgggtagaacctaggctcagtggctcacatctgtaatcccagcactttgggcagtcgaggtgggtggatcacctgaggtcaggagtttgagacaagtctggccaacatggtgaaaccccatctctactaaaaatacaaaattagctgggtgcagtgtcatgtgcctgtagtcctagcaacttgagaagctgtggcaggagaattgcttgaacccaggaggcagaggttgcagtgaaccaagatcgtggcactgtactccagcctgggagacagagagtctgtctcaaaatacaaaaacaaaacaaaacaaaacaaaaacaatgggtacatacagcagcacttacaagagttcatagaaggaattgtacattgtcaactgatagtgtggagagagcagccccctgcccacctggttgtgatctctgcacaacgcttgcccacaaccaccttctccacttagtacaatgcagcccagaacaccaaggggagagccccagcagcagcagcctccgcagcccgctttagatgatagatttagctgagcagggaggtggatgtgtggtgtttacaacctctggttgcatatacataaataaatacttcccatgaagtagaacctcatctagaaaaaattagaagtcatttggctacaagaaatcatgaaagaagaactgggatgtgatgttttccctgatgtttttcgttggctccctaatggaataggttcccttactgttctggcatacagattctctttgtgattctcattcttgtgtgaattatatgtgtactattcaaataattaatgctatatatttactgctttacttctgagaaaactgattttatggtatctgaagactagaaatgattcaacaagtgatagctgcagacttaactaaggtctctctctcctcttttttttcttttcttctctttttcttttttttctactcggtgtcaccctttcaattgggcttttgggtgctcttaaaaattcctcagtgaggcagctcctttcctcccctgccctcagcgtgggaaagactatctgggaatgagccttcctggcaaagagggacaccttggctgagcttttgatcatcagtgctttcaagaagaaagattttttaaagaatttttatctgaggaatgtgagccacttcacatgatcagagacacattaaatcaagacagcaaccactttctgcttccttccttttgagctatgtattcaactgttgaaactgtttgctatcaccccagttagctgtaaattaatctaataatgccacaccaaacactgtatcccacaccctattacaacggatagccaagctctcatcaacactatttctgaaaaccaatgagaattcctgacagccacctttccatcagctcattgtgtgtccccctttttgacctttaaaaacctgtttgtgacaaaggccaaagggagctcagatccaaggttcttggggtgtgagtcttcccggcagctgccttcactttggctcaagtaaactctaaattatattttgtgcttcagggtctttcttttaggtcaacatgttcagcaacagtagaataaataaataagttggcctatattcatacaaaggaatacgcacagaaacaaataaccacatgaataacatgaaaaattcatagatgtaagactgagtgaaagaagtcaaacctatgcctctgctcctgagaccgactttgcaaaaattataactgggacaattatcacagcaaaagaggtttgacctaactgcttccatcttttttccagcgtccaagctgtccttgttcattcctgggcacaggccaaaataactttgagaggaacttagtttatggtttagctgtgaaacaaagatgataacagctctttcccaaaacaaacccccttcctgcctggggactagactgcctttgcaggactaacaaattagtcacaagattagaaatgatggtttagaagtcatgcagcctccagcttataagattctaaacctccccaaattgttcctggggatcacatcagcattgtaaaacctaagatcagtgcgtgaggtattttgtagtcctgcactcgatgcatcagctagcaccacccagatggataaaccagctcatctgatcttgtggcccccacccaggaactgacccagctcaagagcatgctttaactccctgtaagttcatctctgacctgaccaatcagaactcccaactcactggcccccaaccaccaaattatccttaaaaactctggtcctagaatgctcaggaagactgatttgagtaataataaaactctgatctcccacacagctggctctgggtaaataactttctttattgcaattcccctgtcttgataaattggttctgtctaggcagcaggcaacgtgaacccattgggcagttatattcccacaaaacccactacacactttatgatttgatttatatgaaagcaaaggacaggaaaaactcgcctgatagatttggagtctgtggagtattgtcagagtttggggttgtattctacagattaaaagtaatcagttgagcacctcaaaatttccccccaatttttttttctccaaatttggaccaccttgtttctctctttgcagaatataaagtgctaacatgaggttaagtgctaaggtctagagaaggtggaagagatgacaaactccagcaccatgcctgcgtgtccagcgtgctctgctgggacagcatatttgtacattgctgtatttgaaaaaaccctacaagattcatgaaattggaccactgtccttataacactactagtggtaaaacaagtaaggatggctggtttgcagtcatctgagcagcatctctagtttcatagatatggtttctctctgatactgaacggcttccaatttcaagtagaatgctacatcagaagaataacgatgggaagagaaccggtttcttgtgtaatccaacatgttttagtctgcgcattacaaaccattatttgaagaagggtggacaggctctggtagcatgttagtcggctgagtggcggaagatggggcgggaaagttgacggagacgggaaaggcgctgtcggtgacatcacggatagggcgacttctatgtagatgaggcagcgcaggggccgctgcttctccacctgctgcttcgccacgaaggagttctgtgctgtgggagcgagtccaggacagctggtcggacctcagagtcccagctgtgtgtcagggctaggagggctcggggacgcgcggggcaagtgaccgtgcgtgtaaaggttgaggcgtatggagctgtggcggggcggaggtgtgcaaatccgtagttacctgggagggaagatagtattgtgaagatcgtttttccagagtgaggttttttctattgtgtgtactgatccttgcgattttcctaaatgtaggaaattccactgcataatttgtggtagtggggggggctgcgttagtgaattccgctgagatactgcagtgcaaaacgtgagctctacgcgaagggctactcttagtttctatgggtttgtagctttgacggcatgttaagtgtcgtccttactgtctcaagcgtgagaaacagaaagtatcgcgttacggtcctctccgccgctgtcgtgagcttatttaacacaaactaagtggccgcagggctcttccccaacctttctatgtggggctgctttttgcagactttgcttcatggtctccagtctcttgggttctctgtgaaaaccttcgtgttttttcgtagcctccagagtcacccttcacacagcctctgcttctaaccgcagcccccgcagtagtttgtaggatttctgtgctagcagggaatgtgttctcacctcctagagccaggtagaaactctacgcagacgggtgctgttctttgggatgagagcagtgtccccgttccgttgtagacacaacacgcttgctttctgtaggggaacggctctccccgcgcccaggtgcccttgcttatattaaccaaggcccgtaggtcggaatcgcagtctcacctgtcggcagaatgtgctgcgatctaccccaactacccgaactacccagcaataaaatgggacacattacggaaacatgagataaaatggatcatctcaaaaacattatgccgagtgatgaaaagagtgcatcctgtgtggcgccatcaaggtgaatttctagaacaggtaaaactaacctgtatagtgatagaaaatacatcattgattgctggggtagggggagggcgggactgactgcaagggcacaggaggaccttttaaagtaataaacacgtcatcaaacttgaaatggatgcttttatatatgcttttatatatttttaatatatttttaaaatgtataattatatttaatatataatttttatatattttaaatatatacaatatatatttttattattttataattttttcaggtatatatatccttctttattatttttccttctttttccttttgtagggcctgtggggggacagtctagctaaaatatacattcttctctctgtagatataccacaagaccatgagtcaagtgttgcccgaatgtccgaggcccaggtcgccctgagaaggggtggggacttcctgggtcgctgggtccctggcgggggggtccgggcctccgattgcacggggctaggaggctcgcccaggaaggggaccctgcaggctcggtgatcccaacaggatgattcagcaatttccccgtggtccgggccactgtgataactcggtttctgggaccccgaacaccgaagagggagacgaagagggtgacatcgcgaggctgagacagcgggagcagaagggacaccgagacctgcagcgcagagcttctgaacatcagcggaatctccattccatttaggaagtaaaacacggccttaccatgccaatgaaacacaaaggttccaccgagactcgaactcggatcgctggattcagagtccagagtgcttaccattacaccatggaaccatgcaacataaagttgttaaaggtgtctgaattagttcccacccacccatgttaaggcatttctttagattccacaagcaacacttaaggtaggtggacctgcaggaaggagccatccttcttgctttctctctgccctctccgttgatcgacttctgtcatttcatttgcaccccggaaaaagaggcaaaatccactgtgggtttagggccagagaagagcccttgaagcctcggtcatagagtttcctgtgccgaggtgaaattccttccttcccttcccctccctccctcccttcctccctccctcccttccttccttccttccttccttccttcctctcttttcattgagacagagtctccttctgttgctcagactggagtgcaatgcagtggcagtgggtgatctcccctcactgcaacctccatctgtcgggttcaagtgattgtaatccccagtggctgggattacaagcatgggccaccatgtccggctaatttttgtatatttggtagagatgaggttttgccatgttggccaggctggtctcaaactcttgacctcaagtgattcgcccgccttggcctccggaagtgctgggattacaggtgtgagccaccgcacccagcccggagatgaaatatctgcaaaatttctgttattttcttgatgctttccctcttttccatttgcccaaggaggccagatgattgtcaaaacaggacgtgggacttcctgggcaccttgcccccttcctccctgtagtatataacagaagacagcaatcaagtgagattgggaagcagggaatcctttatttttttattcatatacttctatgtttgtttggttggttggttttaacaaaattttctcaccagaaatggagatttgttggatttaaaataaaagcaatcagccatgttttacatttctgtaaaacactcaaaccaggccatactctcctattttgactcaaaatcagccatatactgtccaggtcaggaggcaggcccctgacatttaagcacagtgtgttttctcagaattggccaagttgatgccattccagtttctcaatatatcatgacccattaatttcagtctttaaaagtaaacacgtattgttactgaaagcccaggaattcggtctaggccctgctgctcagctcacagaaagccaatcattaagacattgagtattgctgaggaagaaggctttaattgggtgttgcagctgaggagatgggagatcagtcttaaatcaatctccctgatcaactaaagtgaggggtttatgtagcagggaagaactgtaactgtgggtgggaaaagaggaactagggaagggtgaggaagcactcatgatgagtgaggggtctggcatctcattgtctggaggctgtcatctgctgagtttcaggtctatgatgctttttgagaggcctgagaggcctttgctgaggaaggaactcagataaaacaaatgtcctaagtttcaagctttaagaccagaagggtccatttctatgtctatccaaaaacactgtctgtgggactcttgggttgatttcagtccccactttctatttgtcagttcctcaatcatggggaatctgatcatccatctttctggctgcatcatgtggaggaggggcatcctgagcagcttcacaccatgggtgactgcatggccacccaggaatcaaacattcatctaatactgtagtttctcctgaaacacaatcttcctctgtccagttccccatttccactaaagacaaaacacagcaggaccaacctaaagaagcttcagtccaatatacttggcctgattacccacacaaagtgcagcaagaatccttgttcatacaggctctcctaaataggctttgctggaatatttcacaacgccatttcaggcaaagccctgggaaaattaccaattcctccacctgtgtcctgttataaaagaaaacagaatcttattgaacttatgcaaacaaacacattgtcatgagttaagaatattcagtttacaaattctgtggaaattcggcagacagagaaaaatatgcctcaaattctgtttagaagactattctactcaattgttgcaggctataaatagctcaaaaggaaacaagttctccagactctgaagaatcaacaatgtttgaaacaaacaaaggccataaaaacttatttcagtcctccattagtttgatccatgcaatcaactcgtgctctgtcatattcagctagcaatctctatgaacacatcagtctttctattagtgccctggaaattttctcttaagttcaatggcacaatctccaaagttatcagaaacctgcatccaagagtccttttcatggacttccccaaagaagcaacgcctggaatgtaactgattataagtcactttttaagaagaatcaaagcaaaacaacaattgtggatgacaaaagccttaagacaaccatggttatagatacaattgacaagggaattctgttgcttctgtggcacacaacaatttaacataataatcataattattactgacagcatagcagaactctaggaatctcatacaatcctggaacacacattaacaacacatctgtgtcaatagaacccaaaggaagtgaaacaccacctcagatatgacaatgcttcttgcataattctacataacaaataagcctaagaagcctaatatatctctcttggacttcaagaacctaatatccaaaaagttaatttgaggcccaaaaggctgaatttagaaattttactcttagaaattttgccagatatcaaagttttgagacacttgacatcacaaaataggatcacagatcaccttagaatagtcagtcattcagccaaaatgataaaacaaaaatgttcaccctttgatacaaaggaggctgagttttctaaacagtaagaactaatgaagacatgaggccaactctatccgtctctccctttcattgttttgccttgcagtttactttgaaagtaaacaaaaatattttatgtattattaatactgcacaaacattttgatcaaaagagaaaaccaaattttacctttgtgtggtgtattaaaatgttaaagctaattttagtaaaaccttatacacaaatttaattataatcagtttgaacatgaggtaagagttccaaaaacctttcataaccttttatacttttgtattaaagagtagataaatgctgtagaaaaccctgatattgcaatacacgggcccagatgctggccttgcatcagtgtgtttctgagtgtaatgtctaatttatagaaaatctctgaatttgagaggccagagggccagagtgcgtggatcacttgaacttaggagtttgagtctagcctgggcaatatggtgaaacattgtgtctacgaaaaaaaaaaaaaaaaaaaaaaagaaaagaaagaaagggaaagaaaagaaagtctctcaactaaacttatccctcaaattccagccttacaattctcacgtgcccacctcttctgtctagaagaagagggggcatgaggtggaaaacgggacatgtgggattgttgggcctagagggattgaatggtttcaatttctggttcatgaaagcagttcattttgattttcatcttccccaggatctgaagatgaggcattaattggtgtcaatattcaagatttagcaaaaggaggtatctttttcagatccaggagtcaaagccctataagctaatagcacaaggattagttgataggacatttgtactgcagaaagttctatttctctctaacatgtcaccaataaaaacactatgatcggctgtccagtagttactgcctgaagcacttcaaaccattgtattaaagtggttaggatactccttgcaggtaactagttgccagcattctaatgaatgaactgtgattgaaagcatcaaaaatgtgacagaacctatgccaaacttttccaagtaagacaattaaattttctctccatcatttaataaaatgctaaatgcaaatatcagttttggaaattcagtatgaggataaataatctccttttatttaaatactatacaacaaaacaagagcaaagtgagagtaaacacacagtcatttcatttttttcagctattttacttatttattttgagacagaatctccctctgtcacccaggttggggtacagtggcaggatctcggctcactgcaacctctgtcttcaagtcctgggttcaagggattctcctgcctcagcctcctgagtaactggaattacaggtatacaccaccatgcccagctgatttttgtatttttagtaaagacagcgtttcgccacgttggccaggcttctggccttgaactcctggccttcagtgatctgcccgactcggcctccccaagtgctgaaattataggaatgagccaacacacccggccttcttttcagctcttttaaaagagcataatcacatctttccaagattggtttcttgatatggtactgattactgattaggctgctttcaccattaaaatcttcaaaccagtgcaacaattgcacatgttttgttttcaagtacacacatgaaagcccaacagtgatacaaggcttgggatcaaaaatcactataaattctcacctcttgtttttattaccactttatcctggtgaatgtcacttaattttaataatggtaaacacaacttaaggagtttgagagggatccaatcaatataatatccttaaggacaaggccaacttttctgaccgtggaagctttgtacccacatcacagtttttcctcattaaaggaaagggtctgcaaccaactcaaatgattgactgaaaccaactcacttactgattggattgagtgtgtaccaaacctcaggccacggatgcctgagtcctagtgttcctgtgacatccccttggggtagtggaactctgcctttcaatgatgggaagtcttgggcaagagcaagtctcctccccttgtccagtataaacagcttttatgtctaactctacctcagcagctggcctacacctggggccaagggttggaagggttccttgttgcagcatcagcagtagatgccttttgtttcatgtgagagaagtgaccaggtattgggcctgtactctggtggtggccgatcatgacctatatgcctacaccactgtggcaagctcaagaaattctctttccctgccacacatgtcttgtcagcacttaggatgtgagaggaaagacccagcaaatgggcaaaaaacatgctatgtgtctgggactctcagagattctaagctgtcacaatagttcacacttggcctttaagaaacaataaaaacttcagagattatctccaaccaacatttatggctgtcatcttttccttccattatctgtcagagatgaactgcttcatgtgtttgtccttttataggggggtttctcatgctttggacttcagttgacccaggggccttgcaacttcagctctctggtgagatcaaaacacatgatttcgcagaccatacagctttttctcgtcattagagtgggaacaactgtctcttacagctttctacatcttaaacaactgttgaatcacatgtctgtttaaaaaaatccttatattctcctttatttctggattaacttcccttcaggatactacacaaattctgttagctgatcacttattttgaggctgtgaggtagacatagtgagcaccttgacgatccctgccaatgagccaattcattaggtgctcacgggaaacctgggcccagaccagtactgaaacatgcaactgtcacccacagctctagctgaatttttgtcatgaggctctttctcctcaatcagcatactagtcttagaacaagtttgatattgggactatcttaaaatagtcttcctgaacagctactaagatttgctgggactccaatttctggtcaaatgtgagccagcagagtaaagacatcattcttgatccaggagaaggcaacagtacatggatacaccatatttttcatcaacctcagaacagttatctcaatgaatattgaaattagtgattgaaatacttgtttccccaagtgtgagatgctgaaaattggaaaagtttccttggttgtctaaatgattgtgtgctcagattgaatttgagggtacacaggtgcagcctccagtggaaaagattctaagaactggatgtgggtagaggatgcaattatggaacttgatatctttcccaccttcttttctttcttcctatttctactggtcttgtaatgctaggcccaggcatcaatatacatacaattaaaaaaggcaatattagtgcaaaagacacaatatatatacaatgaaattagatggtgcctattgctaaagttactttaatttcacattgtgtagcccaataaagtgaatgccgcccacctaccaagggtattagtcagctgaggctgccatagaaagatactaaaggttgggtggtttaacaacagacttttattttctcaatgttctggaggccaaaagtcaaagatcgatgagctcacagagttggtttctggggaggcctctcttcctggcttgcagaaggccactttcttgctttgtgctcccatagcctttcctcgtgcctgtgtggagaaagagagagattctttgatgcccttcctcttcttatatggacaccattcctaccagattagggccctgcttgtatggcctcattaaccttaatttcctccttaaagactctgtctctaaatgcagtcaagttgggggttaaactttcaacatatgaattcaggggaaaataattcattttataacaccaagcaatagggacgatcctacgattctttacctattaaatcctatgacgtttgcctggtggtggggccaggaagaagttgttaggaaggctgctattattgctcattctatgattaggaaagcatacttgagctgaagtgcctgccatatgggaaagagtgcaggtcaaacaggtacgaaataaaaataggggaaaatggtagcaaacaaagcagtgcttttaagtgagtcatgcatccaggaaggattgaaattgtacaatttcatggaaatcctattgtctttatcaggagaatgactttacaaggtttataaactagggggaaaggatggtgtggattaaggaccacacctgattgctcagcataatgtgatttcttgactaaacagctataggatgtgaaggaaagatcagaagtcaaagaaaacttaaagattttttgactgagcatatggaaggatgcagtttccatccacagaggtgagaaaatagcaggtgtggcaggttgtaggaggaaaagcagagatcagttcagggccctaaaactttgcttgaaagagttttccatttgccccgtctccatttctgcatccccttgagatttctgtgaggctgaatgcagaggtgcttggccacttctccccctgggcaccagtcatttcacctcctgacagcatcttccatggccctggctctgatgaccatctcccaacacaatgtcatcttgcaaaggtgatctgagcagtagctggagcaaggccatccactccttgacttgtgtggccttggtgggccccaggagcacttcactgcttctcagggtagtaggtcttaggtatggcatgcttctgaggaaaacagggaggaaacagcctgaggggtggaaagggagggctgtaccaggcagcctaggaaagctgagcagacctaggctctcaatgcaaagagcatttaccatctgagaagttctactcatttactattgttagcttagaatctcatctgttaaaatggtatagaaatttgttttcttcctggttatatgtacacctacataatagccttgattttgcctcttggctcacaagcctgcaatacttactatctctggctctttacagaaaatgtttgctgaactctacagaaaacaatcccccatgctttatagaaaaagacacccaggaatctcttttactaattttcttttgttggacgtttttctggccaccaataaggtaaattccctttcttggcttgtaatgattagtctctggttggttgtcatttgcaatggcacaatacatactgagacctcaaagcagaaaaatcatagaagaaaacctaggaaatatcattctcaacatcagccttggcaaagaatttatggccaagtccacaaaagcaattgtagcaaaaacaaaaattcacaagtaaaacctaattcagtgaaagagcttctgcacagcaaaagaccatcaacagagtcaacagaccacctatagaatgggagaagatattcacaaattgtcaatccaacaaaggtctaatgtccaaaatctataaggcacttaaaaaaatcaaaaagaaaaaaaaaacattaaaaagtgggcaaagagacatgaacagacacttcataaaagaagacatataggcagccagcaaacacagaaataaatgctcatcatcactaataatcagagaaatgcaaatcaaagctacaataagataccatctcacaccactcagaatggccactattaaaaagtcaaaaaccaacagatgctgataagcctgtggagagaaagcttataaacccttggagtgaatgtaaattagttcagtcactgtggaaagcagtttggagatttctcaaagaacctacaacagagctgctattcaattggtaatctcatttctgggtatatacccaaaggaatagaaatcattatgacaaaaagacacatgcactcctatgatcaccaccagcctattcacaatagcgaagacatggaatcaaactaggtgcccatcaatggtggattaaataaagaaaatgtggtacatacacaacatggaatactacatacccattaaaaaaaaaatcctgtgaggccgggcacggtggctcatgcctgtaatcccaggactttggcagggcaaggcaggtggatcatgaggtcaacagatcgagaccaacctggctaacatggtgaaaccccgtttctactaaaaatacaaaaattagctgggcgtggcagcgcctgcctgtaatcacagctactcaggaggctgaaacaggagaatgccttgaaccctggaggcagaggttacaatgagctgagatcgcacactccactccaccctggcgatagagctagactccgtctcaaaaaaaaaaaaaaaaagagtcccgtggacagaagattttcctggtggagtgtaaaacaaactggggtgatagaaatgagttctgtggacgtgctgctctccacttggggcccatccttcattttgccgagaccaccaaagactgggccttcctggacaggaggggttcctccccacacgcctccccttgggccccagtcccccaccactgcgtgtgtccgcccaaccctacagcttctctcctttcgggaatgtcatttcttgaaccgcactccatcacaagatgtggtccaatggtctatccaaggtccaggcagagaatccgtgatcaggtgactctttgtattgcagggatctgacagcagagacaataaaagtagcaccagttttagggccaaatatgcagaaacgcagagaccaaccagacccactggctgcttcatagactgtctctataaagtccctgcttagataaattccgctccagggccgggtacaccctgtaagaggctggtggattatgtgaggtcaggagttcaagatcagcctagccaacatggtgaaaccccgtctctactgaaaataggaaaattagcaggaaatggtggcacaaacctgtaattagagctacttgggaggctgaggcaggagaatcgcttgagcccagaaggtggaagttgcagtgagccaggattgcacatattgcactccagcctgggtgacagaccgagactctgtctcaaacaaacaaactaacaaaaataaataaataaaagaaagataaattcagctagggaaagaacccgaggactatacagtagcttccatttttttttctttattagtgtggctgtgacctctttgagggtcacaattacagtaagtaaatgtaaaaaccacagggcacaaagacaggaccctgcatttgccagaaatggaatccaggtctcccgggtgggaggtgtaatttctaccactgaactgccagtgcctcctgaccctgagctctgcagccttggaaacagttaagacacagacttggggaaaggagtcaagattttcgctgtgttctctttgatgtgactaacaaaaaagacacccagagcaaaggctcgcagtggtgatttgcatcaggcaacaccacaaagttatggcttcacattaaaagagctgacttgaaaaagccttattctgagtaggctctgtgcaacttgataacaaacctctgtaggaaaaatcagaaattcacccagtttcttgtctctggtcctgtatccagtgtgagcctgtggaaagttcttgcctcgcttgttgatgtcttctctttgcctccccattgcttggtgcctctcaaaccctttcctcccaaccttgacaggaacatcagtactttctccaaaaaaggctgtcagagaacagggaccctggtttggaaagctgaactcttgggactatgcctgggatactccaggagaccagggtgataattgaacttctctcctcctacacctcttttgaattcctggaaaaggcctgggattggatcttgcttttaacttcttatgccttacagagacctaagcaagagcgaagaaatggacatttcactcccagatttcttcccttcacctcaccctggttggccacccaaggaggccagttcagggaaaaacagttccatttgattctaggtagatgctaggatattactcctctagctaacagaaagtgttcttttgttgtttgcttttgttggatattcatgttttcactctcattcttttgtttataatgagcatggtacagatttgcactgctctttttgttgttgttgtttgttttctttcctttttacattttttatttccaacttttcttttaagttcagggtacatgtgcaggatgtgcaggtttgtcttataggtaaacgtgtgccatggtggtttgctgcaccgatcttcccatcacccaggtactaagcccagcatccattagctactcttcctgatgctctccctcctcccaacccccaccctccaataggctccagtgtgtgttgtccttgctccccaaccccatgtatccatgcattctcatattcagctcccatttataagtgaaaacacacggtgtttggtttcctgtttctgcgttagcttgctaaagataatgtgtactgcttttgacctggcaccgtcgttcacacctgtaatctcagcaatttgggaggctgaggcgtgtggatcatgaggtcaagagttcgagatcagcctggccaatatggtgaaacccccatctctactaaaaatacaaaaattagctgagcacagtggcgcgtgactgtagtcccaggtactcgagaggctgaggcagaagaatcacttgaaccaaggaggtggaggttgcagtgagctgaaatcatgccactgcactccagcctggtaacagagctagactgcgtctcaaaaaaaaaatgtatatatatgtatatctccctcctatacaatatatacgtatatatatatatatataatataatgtgcactgctttgaatatttaacccttttctgcccattaaaccattagagctggcatttccttttctatccaatctgagagacttaaatccattataattcacagcagttagtgttacattggagatgacaggcacagttagtctcattcccaccacctcattgtatgatttctgtgttttggctttgtttataaaatctcttcctgcctttcttaactagactggtctgtctgggtaaattttctgtttttctgtagtgtttttgaaattccatgtccctgattagttaatatattttcttagatctcaggtgcacagggagaaggtaatcatgtaccttagctcagggcacattatggtggcagctctgagcaaggcacttactgtctttccttcttttctctgtttatcccactcccatttccctgtccacttccagaaacacgttctgaggagtttagtatatgctcttttatctcacactttctctgcatatttcaataaggggatgtctttggaagacatacattgttctttgaggatggaggatattaaaacaactttaaagtttgaattggtttccaaaaacccattccatcctctttactccattctgtgtactatcttctcaacttttctattcaaatagaaaagtttgtgtataaatttggggaggaagaaaagagtcaagccaatggaaatgggcaaaatacttgaacggtgtttgtttaccaaagagaatttcttaatggccaaattgcataagaaaggattcttggcattattactcattcaggaaacacaaatttaaaatgccatgatactccataacacacccatcagaatgggtaacatttaagagacagggaaagccactggcttataaaaatgcagagcaactgtaactcttgttgctggcaagagaatgcaatactgtaaacaaacagatgcctgtaatcccagcagtttgggaggccgaggtgggctgatcccttgagctcaggagtttcagactagactgggcaagatgaggaaaactcatctctaccaaaaaaattcaaagaattagccaggactataggtgtgcctgtagtcccagctactcaggaggttgcagtgggaggattgcttgagcctgggaggcagaggttgcagtgagctaagattacaccactgaagtccagcttgggctacagggtgagaccctgtctcaaggaaggaaggaagggagggagggatggtgggtccaggtgcggtgatttaccactgtaatcccagcactttgggagtctgagtccagtggatcacaaagtcaggagatgaagatgatcctggctaacacagtgaaacccccatctctactcaaaatacaaaaaatgagctgggcggcatggcacatgcctgtagtcccaactgcttgggaggctgaagcaggagaatcactggaacctgggaggcggaggttgcagtgagccgatatcatgccaaaaccacaatatcagagatgataaattcgctggatgggattaacagcagattagatgttgcagaagaaatgatcagggaacatggaatcatgaataattgaaaatatgcaaaatgaaactcacagacaaaagagattttttttaatgaaaagattatcagtgaactgtagggcagacttaagaggtctaatttttgagtaatgggagtccctgagaaggagcagggaggaaaggaaacatttattttctttctttgttatttttcttaggaatggggtctcagtatgttgcccaggctggtcttgaatttcaggcctcactcaacacctcccgacttggcctcccaaaggtgtgagccactgtgcccagccaatttctgaagaaaaatagctggaaagttcccaatcataacaaaaattataaatccagtgacccaaggagctgaggaaaccaaagcgcaagaaacatgaataaaaccactcctagatacatcataataacattgctcaaatctggccagaagaaaaagacattgtacatacacaggagcaaaaatgaggattgcatcagcttcctttctgctcttgccggcctctaccaggagcagcaatgcacacgagcagacagagaagcaacatctttaaggtactgagggcaggagaagttaatgtagaatactatgccagaaaaaataaattcccaaaagtggaagtgaaataaggacatttagagatgtacaaaagctgaccgaattcactaccagtcaacccacactacaagaaacatcaaatgagtcctccaagcagaaggaatccaataccagatgaaaatccagatctccacgaggaaatgaagaacaccagaaatgggtaactatactaggtatttttttattttgtaaatttcttttgtaaaaatttgaccatttaaacaaaagcaataacaatgggttgtggtgtttataacatgcgtaaaagcaaagtgcatgtcagctatagcgtcaaggccagaaggtgagatataatatcacttgaaagttgactgtgataagttaaaaaggtttgctataagccctaagggaattactaaaataacaaaagaaagagttatagctaataagccaacagaagagagagaatagaatgatataaaaactttatgaacagtatgatagagtaattgttcttcctatagtaattgcacctctagcctaaagaaatatttagaccagtggctgaaaatgcccgtacaagaatgactagagcattatatgtaattataaaaaaatcacagaaccaatttaacctcaaaagcatatggaaagggctaaatgaatgacagttaaagagagagagagagagagagagagagagagagagggagagagagagagagagagagagagagagagagagagagagagagagagagagagcggcgcggtggctcactcctgtaatccagcactttgggaggctgaggcgggcgggtcacaaggtcaggagattgagaccaccctggccaacatggtgaaaccccgtctctactaaaaatacaaaaattagctgggtgtggtggcgcgtgcctataatcccagctactcagggggctgaggcaggagaattgcttgaaccagagagtcggaggttgcagtgaggcgagatatcttgccactgcactccagcctggccacagagcgagactccatctcaaaaaaaaaaaaaaaaaaaagagagagagagggttcccagaatcctagcggaccttgatttacgtcctcacgtcctacgcgacagacggaggagaggagggtaaagttagtctccctctgcctttccatgataccatgtgctggatagaagaaacttgccagcggtttaagcatttttaaaatgcaagaaatgctccatagaacaggctcgaaccacccaccttcgggcttggaaacaagcacaccacccaactgagacacacagacagacgactctcactctggtatcaccatgcagagcaagagcccatccaacgttaggaggagccaccgccttttttagaacaactgtgcaggctctaaagcctcggaaaacctgagaggcgcatcttgctggctacggttgaaacccgtgcattgggtgattccgaagctggaagggcagcggaatggccttcgccccgtcctgaccctcgcaggcgtcagacccagcatcccaggaaacgcccgggtccgcgactccctgggcctgagccgcgtgggtcccaggggaagcaagcagaacgccccgtgggctctagtgatggctcttccccttcttggctccgccttcacccgattctctactgctgcttgcgctcccctcgctcacctcggcctcggtcggtggggcgggagagaggaggggtgaaaagcagaaatacggagaggccccacagaagcagaggaggtgcggaccaggacagagagacctcccgagagaggctggtgcagggaggcccaggctggagtggaggagatgagaattgttctcatcacgtatgaagattgggaggaagggagggaaaagcagagcgggcatgaaagaaaagcgcgagtcccctgtggctgtctgggaacgaatccgcctaataatcgaaatccattgacgtcaaaagggctagagcaagctccgccatcgcggcttagcctgtggctcgccgtgatcgtatagtggttagtactctgcgttgtggccgcagcaacctcggttcgaatccgagtcacggcaatgtcgttagtctaggctgtcagctcttcccttttgctcccgcaaccaggcgcgtcaggggaaggaaaagagacctcacaccttactaacttggcgaggaatccaagggaaaccctggacgtgctccctcctgtttctgagcctcacgcagcaaataacccagtcggccctgttggtggcttacacgaaggcaatggtgtgctcagaaccgttcttctggtcactgggggcacgtcggggtaaggaaaagagacctcacagctcactcacctggggaggagtccaagggaaactctggacgtgcaccgtcctgtctctgagcctcacagagcaaataacccagtcagccctgttggtggtggcttacacgaaggcaatggtgtgctcaggacctgttttccagtcactggggctgttacacacgaaacgacaagaagcttttaatgactttaaactccaaactctttgttgtggcctacaatggcttgtctctgtgcccgtcaccaagtttgtatgccaacagcaaagtgtgaggaaaggcaatctggtgccaggggtctttccacctccactctgccacgtaggaatgggccttgggcctggagcacttccttcctgagagataaggagtcatcacagcctgtgctggactcacctccttgtgtgggagtatctttcccccgatcagacttggtgtgtacccctttgttccacttaagcatgtgcatcaactggcacctggccagctgctgtatctgccccccactgaggggaggaagcgggggtcctttcttctgcttctcaagaggctgtgtgtgcaggccaaatggagggacctgctggccatgggggaccaacgcccaagactgaagcggagcccacaccccgctctgtctcctctctgtatgaataatgtgttgttctcccgtccagtctctgactgccttgtatttccttggcgactctgataccaagaggctagggccagaagtgttcagactcctgctgataggaaaccgatgccacttgctggacaagatgaacgaaaattcttcttgtataggtctttttgtggacacgtgcattcatttcccttgaggaataccaagtactggaattgttggatcatagggtaggtgtaatattaactttattagaaacggccaaatggtttcttccagaatgctttctcaccagcaaggagagttccactggctggacatccttgacagcgcgtggtgtttactgttttttaaatacacctgttctggtggatgtaaaacggtaccacatcgtggcttcaatttgtgtttcctttaatgagtaatgctgttgagcatattttctaatgccttttcaccgtttagcaatccttctttgagaagacaggctttgaagcattttccctaattcaattggctttgctttttattactgatttgtaaaaagtactctctatattcaaaatttgagccttttttttttcaggtaaacacagtgcaattatcttctcccagtctgtggctcaccttctcactttctcatggtgattcttgatgagcagaagttgataactttggtgaaattctactttgctttattttttcctgttatctcttaaggcagaaatgtattctgctacattctcttccaataactttagggtttcgttttaatttctaaatctatggcatatcaaattcatctcctgaccacagcaaacttagcatctgctaatgtcctgatcaccagaaaacttctgtatactgtaaatacactggcaagagttacttctctgctgtttcacagctatgggccctgtgcctccctccatttcttccctactcctctctccctctgtctccttctctgtccttctgtctctcctctgatgcagctgagaatcccagagacatctgaaacagagaagtggacaggtccagtctaatctatgtccaagaacccaggttctgtattagaaatctatgtcggcccttgcctgaccttggttaactatcttaaattttatgtgcctcaacatttttctgtggaaggttgggcctctttgggaactctgccttacactgctgttgtcagacgggcctggatttagtgactactcaatcaataacgtaatcactagaattataaaaatcattatcattgtcctctgccttatttgtgaacaatcactctccagattgttttcactttacctttgcttgtagaacttcacgcagatggaatcaccttgcatctactctgttctacatgcttctttctctctgcataatgtctctggctctatccattgctgagtgtagcagaagttcattcctctttcattgctgagtagtattccattgcaaagagacagcacagtttgtttgccattctcgccccacctccaccccgataatgagcgtctgggtattggctattctgaataaaccggtattgggtattctgaataagccggctttgaactttcttcccacaagagattttgagggcacctgttttcgtgtctcttggggaaaacctagttgcctaattgctggtaccaaagagtgagatatgtgcaagatcataaaaactcacaaaacttggcccaaagtagttgtgtcattttacatttccagcaatgacgtgtgagagttgtggttgttcttcatcttctccaagattgggtgtttcctctccttataaatttagccatgctactgggagttatagtggtgtctcaatgtggttttgatttccattttcctgagagctaaacatattgtatatgctttgttgaccatgtgtgtaccttttattcttatgtatctgttcaagtcttttacccatctagcatacttgggttgattggtttgttgttgttgttgttgttgttgttgttgttgttgtccttgttgttttaattaccaggtaagaagatctcagcatactttatagttacagggtttgggggtcagataagtttcgtgactattttctccctgtctgaggctgtctcatttcttcactttctttgttgcctcttttgatgagaagatatggctaatatttgatgaagtctaatgtatcaagcctttcctttatacatttttttctgtgccctatttaataaatctctgtctaccaacaagtcacaaagtatcctcgaaatgctttatatctttggcttttatattttggtctataatgtgtctcaagttactttcaagtgtagtgtgagggagaaataaccttgttcgtctaccccttctcctttatgaaaggcaattaattgaaactatttcctttgccccattaaactgcttttattgaaaacctatggccagtcatggtggctcatgactgtaatcccagcactatgagagactgaggcctgtggatcacttgagcccaggagttggagaccagtctgggcaacatggagaaacctcatgtctactaatatgtgcctgtagtatgagctacctgggaggctgaggcacggggatcgcttcagcctgggaagcagagattgcagtgagccgagatcgcgccactgcactctagcctggatgacagagtaagaccctgtctcagaaaacaaaaagaaattaacaaacaaacaaaaaacctatgaaccttatagctgtgggtcagtttcaggactccaaagtcagtctgttgatgtatttgtgtctcccaatgccacttgcacactgccttgattataacagcttagagtgagtctgaaactcaggttgtgcaagtcctctggttttcttctttttcacacagcataataagctttgaaataggtcataactcatgtaaccatcacatagatcaagatatgctgtcacttcatacctctcatttcagtgtgggatacaagtacttgcacatctatgctgattgcccccttggggccaaggatcattgttacgggaagtcagggaccccaagtggagggaccggctgcagccaaggcagaggaacataaattgtaaagatttcaccttaatatggacatttaccagttctcaaataatacttttataatttcttttgcctctctttactttaatctcttaatcctgttatcttcataaactgaggatatacctcacctcaggaccactgtgataattgtgttaactgtacaaattgattgtaaaacacgtgtttgaacaacatgaaatcagtgcaccttgaaaaagaacagaataatagcgatttttgtgaaacaagggaagacaaccataatttctgactgcctgtggggtcgggcaaaaagagtcatatttttcttcttgcagagggcctataaacgaacatgcaagtagtcaacatatcactaaattcttttcctagcaaggaatattaatattaatactctgggaagagaatgcatctctggggggagggctatgaacggccactctgggaatgtctgtcttgtgcagttgagataaggactgagataagccctggtctcctgcagaaccctcaggcttactagggttgggaaagctcagccctggtaaatttgtggtcagaccagttctctgctctcaaccctgttttctgttgtttaagatgttaatcaagacaatacatgcaccactgaacattgacccttatcagtggttctgcctttgccctttgccttgtgatctttgttggacccttatcagtggttctgcttttgcccttttccctgttccctcagaagcatgtgatctttgttagacccttatcagtggttctgctttttgctatttgaagcatgtgatctttgtacctactctctgttcttacacaccctctccttttgaaacccttaatgaaaacttgctggtcggagactcaggtgggcatcacagtcctactaatatgtgatgtcacccctggcaccccacctgtaaaattcctccctttctactgtctgtctttatttctcagctggctgacacttatggaaaatagaaagaacctacgttgaaatattgggggcgggttctcccaatagatcctctcttctaccctctggagagaataaatcttcagttgtctgcagggaggatgaacacacaaaaagtccacaacactcagcacagagtccagattttggtagtggggttgatggggaggaagctcacatttcaggcctttcaaaatcttaggaaaagttttctttatttctaactgtgaaatgtacaaagctttgggtcatttataatttcttcttcttctcgaaagatcacaggagacctaatatttgtgtccccccaaaatgccttggttgaaaccctaaccttcccctgtccacccctggaaagtgttaaaattaggaggaggggcctttgggaggtaattagatccagagggtggagtcctcctgagtgggattagtgcccctataaaagggacactagagagctctctcagcctctttcagccccctgcagatacagtaggaagatggcagtctatgaccaggaagaggttcctcaccataaccctaccatgctggcaccttgaccttagacttccaaactccagaactgtgagaaatgtctgttgtggatgagccacctagtttatgttacattattatagaagctccaactaagacagagatggagtcccatggagggtgtctaatttttgatgctggtcattgcgttcttcaactgggatgttgcaaattagaaactgagggagagctgacctttcctgcatatgaaagaagagagtggaggggcagagatacagaatggggaagaacaagttggaaccagaaaactgatttcagggtctggcacttgaatgtctgattttggagaaagagaagacactggtaggtgtatccagagaagaagaccttcagtggaaatggcagatatttaaaagccattcgattacatctttcacttgtttgtatgtagtccctcttctctcatctttgtaagtgtggcacaggtgaactggatgtgtttgtccaatgtgtttttggaatgcatgtgtaaataaaaatgactgtgtcatatttcagatattcatcccggaacctcctagagttcccttaggttccatcaactgtacattgaaagtacaacaggcggatcgtggggattaattttcattggacatttctaggaagagggaggaggaggagggggaatgtgacagtctcagcagcagttactatactcttaccgaagtggttttcctatgtgcttctcaacagatcggccctttcttcaaataagagcagttggaataacaaagctgttcagttgtacccttggaatccactgaaatcctgggtagggaagctccagtaccaccaactggaaagactgggaatgcctaatagctggtactggccattgtcgtaggctttgtccactctgacaaactgaagatggggactcgactcaccttcgccagccacaggaggacctccagacgaggttaggtcgacttcccgataactttagatcctgaaacctcacaggatttttcttctcttccctttgatctctcttccgcttgctcaacaggacaggactcgctgcctttctttcccgtcagaaagggatcccttgcggacaggacctaagtgagtagctggtttcccctacttgtccttccgggcctgggtgtctcgggggctcaggctgacgggagacctaactaccggcgagtgagaccagcaggagcctggaggggcgcgcaccagggtggaggtttggtgccgggggttgagaacaacagtcaaaccctcttcttcccctggcaccacgcacctgccccccgggatgccgaacgaagtggtccctaaagctcctctgcaggcccaaccgaaacaggcctgaagctccaggatgggcgagaggatcctctttgagcgaaaccagccttctgcctggctggccctggtcaacaccctgggaagaggccgatttggcggacagaacggaagaaaagacctaaaggtagaatctcatgatgtcgagatgttaaaacactcaaattttaaggttcgactgtgagggggagatagggggtctcgagctggatcgacccctgagccttcatctgcagagtcctgtgcaccagctcagaggacaggactatgtgcaccaatggttctcatcaggcggcaacttcaccctcacatgcctcccccatccctgctggtacacaagaccacgactaggggaagcccggagggagaatgttaacccctggcatctatctagtgagcagaggtgagggatgctgctaaacaccttacaatccaccggaggacacccgcccccaccgaccccgaagtagccattccctggaggtggggaaactcgcctgtagatcaatgcccacgcacttggcggacaggaaatcacgaattggcgactaactggatcttggatctgaggaaaaaattccagcgtcagagggaactctcggagatttgcccagagcataaggaacgtactccttccctcagtgatggatcctcacatctgggggaaatcatagacaatttcttttgtagggcgaactctgctatacagtttatgatgtcagagtgaatactttctttgagttgcagtcagaaactgtagatttttaaaaatttaaaattcattattctctgtcagtattccaaagtgtatacagaaagctattgcactgttcaggagatggcgcttaacattttggaaattcaaggtgatgaatgtccagataagactatctctcctggtacaaagtttgacaatgctgaacatttttaaaggttctttttgatatacaaagtgcaccaatgagtgctttttaattcttacaataattctgggtgaggtaggtatttttccaattcccattttatgcttcggtagccctttgtatttatacttcaaaacacttggctctcttgtaattatttaagaaattagttgtgattatttgtttaatgtgcaggagttacaaaaggcaagctttagaacaagacagacctggttatgattcctggctctgaaagctgtacaccctgtgaccctagacaggtgttttaatgcctcgctgcctctgtttcttgctctgtaaaatgtgaacaataacagtattggcctcatgctttttttgggttttaaaagtaataatgtggacaaagatcagtggagtgcctggcatgctgaacccattccatgactgttagatatagttgttatgatttgtatcaatccattttcacactgctataaggaactacctgagactgggtaatctatgaagaaaagaggtttaattgactcacagttctgcatggctgggagtcctcaggaacttacaatcatggcagaaggggaagcaagacatttcttatatggcagcaggacagaaagagagagagtgaagggggaagtgccacacacttccaaacaaccatatcttgtggttaattaaaaagtactcattggtgtgccttgtatagaaaaaaatatacactcactatcatgagaacagcaaggagggagtctgcccccaagattcaatcacctcccagtagacccctcccctgacatgtggggattacaattcaagatgagatttgggtggggaaacagagtcaaaccatatcgtgattgttctataataaagagatgcccacatgtgtttcatcagggacagtgctcattaaccagttgtcctgccgtaattattaatagtatcccctttgctttcaaaagtgtcctagtttacaaaaagtatagaaatggaggacagaatagtggttgcccaagattggaaaagggtaagggtaaagggtgcagaggtggatgtggttataaaaggcaacatgggagatcctcgtagtgaaggaactgtttagtatctccactgtggtggtagatacccgaacctaaacatgtgaaaaattgcatgaaactaaacacacacacaaacaagtacaagttaagttaggaaaatccaaataagatttctacattgtatcaataggtatatcttgattatgatattgcaagatggtactattcaaggaaactgggtagaggctacatgagactcccctgtattatttcctataactccatgtgaatctacaaggatctcaggattaaggaagatatcctagtttggaagataaaaaatatatcccagtagtaatatccactgtcccaccagggcctgactaccttctataaaaagaagtgcctttgttcccctcaagttcctttatttggttttattcttcttcacagtacctacctccacttggcagattacatttattttttcatctttcaacagctatttactgaatgcctactagatgccaggcttgagatctagcaatgaacaagatctctgtgaaacttacattccaggaggagaaataaataataaaccaaaaatataatcagtaaattatttaatatgctgggaaacaatatgtgtaatggaagaaatatgtaaagtgatggattagggttctccagagaaacagaaccaacaattgactcatgtgattatggaggctgagaagtctcaagatcacagttggcaagcttgagacacaggagagcccatggtgtgtttctgatttgagtccaaaggcctgagaaccaggagagatgatggtgtgattacagctcaaaagctggcaggcttgaggcccaggaagagccagtgttgcagttcaattccaaaggcaggaaaaggctgatatctcagctgaagcaatcaggcagaaggagctctctcttactcatgggcaggtcagacttttggttctattcaggcctttaagtgattggatgaggatcatctactggggaaagaaataagctttattcagtgtactgattcaaatgttaatctcatccaaaaccatgctcacagacacacccagcataatgtttgaccaagtatctgggcaccttgtggttcagtcaaattaacacatattaactaccttagcaagatgaaaagcagtgaatgcaggatggtggttgaaattttaaatacgttggttatatagtctcattgaaaaaggaacatttgagtgaagacttgaaggggtggtggaataaaccatttatttgcttattgcctgtctccctctatcagaatgaaagcttcatgaagcgagagacttaatttttatctgttatatccctagtgcctggtgcagggtaagtactcaaaaatatttgttgagtgaataagtaatgattgaggatggggactggtttgtatctggttatatctcttgtccttagcacagtacctggcacatcctaagccatccaaaagagttggttatatgattgtctttgaattctatgactgtttataatatacagtaaacttcactgaagacactgactcacttgttttgtttgatattgtggccccagcactgcagcacttagaacagtgcctagaaaatacataatagttagtgaaaaattgttattgaccaaatgggcacagataaggagactgaggctcagaaatgttaaatgagttgaaaatagtctcacagccaggaagcaacaaagcatggggcctaactttgtctttttaattctcaaattacaatatttcatctatatcaaactgctttaaaaattgtcctggggtctctcgtttggccatggcctttctttcacctacaccatctctcttccttgtccactccaggctgtgttgtgtggtcatgtctccctgagtgacaagcaggctggttatgtggagttgtcagcacacaagcctcccagaggatggccttctcctccaggtgccacagtgtcaggggacactctcttccattagcacaagcagaaggtaatgcaaccttttggtggccatcgactttgtcagacaatagtgccgttcagtttgaaagactccactgggaagtcgcagacttttaaaactaatttggtgtttattcaactttgcaatcacttctatgtactatctgtgtttcacacaccatgaaacggtgctatactgtgcaattgaattagttgtacagtgactcaaaggcattaaacaatgactttgatattttaagtactgactaggagggatttttaattccttcctcataatgaaaacagcaaaaaaaatccagttacacaaccctggaacacttactctcttttctcttctgggtggaccccagtgagacagaaaaaacctccgagcacttaatttgcttcatggcaggagaaaaattaaacaagcatagacgtgcaaccttaatgacacccagcaacactagaataacagttcccagcttctaaaacctgatatttagtataatgggtaaatctggtgggagcttttcagtgctgctgagtttgaaaaaacagctactttgtgaggaggggtgggggtagaggcagggagagtgtcttgcttgtgctcacttgttaggagggtctcagtgcagaagccaagccagaggggtgcaggcaaaatacagcactggcaggagagtccctgaaggctgtgacccttctgcagacaacagcatcactatgctaggcacaaatgtgtcagttctgccagaaacaacatgggacttttcatacagtgcctttctggagatggtactgacagaaaggaagaagagagggggaaaaacaatgcaacaaaaaacgaaaaccatagcaagtgaattagtaccatgaaactatgagcattaactggttatagttcagggcaaagcacctcagtgatgattcacatctgacaataaatacaggaatagctgttgaaagctagtttgattttcacaaagaggtttaaacaaactttcgtttgttcattagtcttaagcaacacatttatggcaggggatgcattaaacctaacatatgtctgtgaccaaggtatttggtggttttaaagatgaagacacaaagccgtgcatatagtttatgcggagcggccttgaactacccgtaatggagtgagatacagttattatgtattaatgctgtgaatcttcatccagagagagaaaacaaacaggcgagaaggaatgcagcatctttgaagataaagacttagagggccccattctgcaattggtattgagtttgcataaactcattttgttgttgttgttgctgcataatttttaaaatgcaactggtttaaatctgttccctgaggtaatttacgctaaagcagcattctaacaccataaattccctgcttatggcaatctctggttgggtgtcaggtcggtgtaagttactgagcaaatggctgcttcaaaatttttagggtaattgcctctataactcgtttagcataggccttgtcaggaaatctctaattgtaattgatgcctctgcttccttttctcctcctgctttttaaccacattgttgtactaaaagcttcactctccagtgcagaagagcatggggcttttcatcttctgtagcactcggattttgttattattaaagccttccctcatgaaaacgtgatgtcacccccgatggggtccagaaggtggtggttggttgggtgtacctctgccccagcccaatctctacccttgcctaggaaaccttcagtacagagaaggtagatcttgatggggttgagataaaatgaagagcaagttaccactactccaattctaagttttgtatgaatgctgggttggctgttgatttctaccagaatggtgtgagcaaagtcaacagcatatttttctctcttctctcatctcatgtgtatgggcatgatgccttggtaggaagggtatcattggaattgtatattacaatattcatggccaggagcttctgttgatttgtgtctacatacggggatttttcatgaaattgcataaagcatgttaaagaatcaactccaaaatccaatttgttaattatcttgcttaaaatatacttcaattatatcacatttgacatcgtatgtcattgatagtagagggaaataacacttaaaatcaataagtgtttttaatttattttacttattatgcttgtcataatattttgacatggagtgctgacatgtcaacgatgctgttatcaggaggtaaggcaatggcattaaactgtctcaccatctgtgctactgtttcagcataaagtgggcccatggggaaaatatagctaaaatctccaatgaagtgtctgcttatgaagtaaatacaggtcatcactgaataaagcagcctgagctcaaaacaaaagctgagggaaaaaaatccacactctaatctattatcttttctcccaaaggattcaacaataagagcactaaaaatatgcgagtgctgtctgtgtgccagacttgtgaaaagtgttccacatattttatctcatctcctctaagaggtgaggtacttgcacatggcaaaacccagctctgaatgaaagtctgtgtgattccatgcctggatctattctcagaaaccaaagccatcactattctatatggtttggatagaaaatggattctgacttctggatcctctcctggctattacaatccacatcgcaggggggtgaggcaccccccgcgatatggggagtcatagcaaccccctctccccccctggctgtcacaatccacatcgcaggtgtgtgaggcaacccctgcgatatggggagtaataggaaccccctccacctgccccggctatcacgatccacatctcaggggggtgaggcaccccccgcaataaggggagtaatagcaacgatctctccacccctagctattacgatccacggtggactcatagcctgtttacgatattgtgagtatatatcaactccccctctggaaattatgaactatttcacagacctgtgtacacccatctgtattgggagtaatatcaacctctttctccctgaatattgagaacagtatcacaggagtgtttctactccctgcgatgttgggtgtcatatcctcctctcccacgttgaaattagaaacaatatcactgggggcgtgtacaccttctgtgatatttaaagtaatatcctcttccctccaggatcatgggaataatatccctggggggtgtacactttctgcgatatatgtagtaacatcatcccctccgccttggaatattattaaggaccatttcacgcgggggtgtataactcttgcgatattgggaatattattatcctctttccccccctgcatatttggaaaaatttgagggttttaacatctcgacatcatgagattctacctttaggtcttttcttccgttctgtcctccaaatcggcctcttccgagtgtgttgaccagggccagccaggcagaaggctggtttcgctcaaagaggatcctctcgcccatcctggaacttcaggcctgtttcggttggacctgcagagaagccttaggggccacttcgttcggcatcccagggggcaggtgcgcggtacagggaagaagagggtttgactgttgttctcaacccccggcaccaaacctccaccctggtgcgcgcccctccaggctcctgctggtctcagtcgccggtagttaggtctcctgtcagcctgagctcccgagacacccagccccggaaggacacgtaggggaaaccagctactcacttcggtcttgtccgcaagggatccctttctgacgggaaagaaaggcggcgagtccggtcctgttgagtaagcggaagagagatcaaggggaagagaagaaaaatcctgtgaggtttcaagatctaaagttaccatgaagtcgacctaacctcgtctggaggtcctcctgtggctggcgaaggtgagtcgagtccccgtcttcagtttgtcaaagtggacaaagcctacgacaatggccagtaccagctactaggcattcccagtctttccagttggtggtactggagcttccctacccaggatttccgtggattccaagggtacaactgaacagcttttgttgttccaactgctcttatttgaagaaagggccgatctgttgagaagtacataggaaaaccactttggtaagagtagtatagcaactgttgttgagactgtcacattccccccacctcctcctccctcctcctagaaatgttcaatgaaaattaatccccacgacgggcctgttgtactttcaatgtacaattggcagaacctaagggaactctaggaggttccgggatgaatatgggaagtatgacacagtcatttttatttacacatgcattccaaaaacacattgaataaacacatccagttcacctgtgccacacttacaaagatgggaaaagaggaactacatacaaacaagtgaagatgtaattgaatggcttttaaatatctgctgaaggtttccactgaaggtcttctaccagtgtcttctctttctctaaaataagacattcaagtgccagaccctgaaataagttttctggttccagcttgttctttcccattctgtatctttgcccctccactctcttcttacatatgcaggaaaggtcagctctccctcagtttctaatttgcaacatcccacatgaagaatgcaatgaccagcatcaaaaattagacaccctccaggggactccatctctgtcttagttggagctaatgtaccataaactgggtagctgatccacaacagacatttctcacagttctggagtttggaagtctaaggtcaaggtgccagcatggtagggttatggtgaggaacctcttcctggtcatagactgccatcttcctactgtatctgcagggggctgaaagaggctgagagagctctctagtgtcccttttataggggcactaatcccactcaggaggactccaccctctggatctaattacctcccaaaggcccctcctcctaattttaacactttccaggggtggacaggggaaggttagggtttcaaccaaggcattttggggggacacaaatattaggtctcctgtgatctttcaagaagaagaagaaattataaatgacccaaagctttgtacatttcacagttagaaataaagaaaacttttcctaagattttgaaaggcctgaaatgtgagcttcctccccatcaaccccactaccaaaatctggactctgtgctgagtgttgtggactttttgtgtgttcctcctccctgcagacaactgaagatttattctctccagagggtagaagagaggatctattgggagaacccgcccccaatatttcaacgtaggttctttctattttccataagtgtcagccagctgagaaataaagacagacagtagaaagggaggaattttacaggtggggtgccaggggtgacatcacatattagtaggactgtgatgcccacctgagtctccgaccagcaagttttcattaagggtttcaaaaggagagggtgtgtaagaacagagagtaggtacaaagatcacatgcttcaaatagcaaaaagcagaaccactgataagggtctaacaaagatcacatgcttctgagggaacagggcaaagggcaaaaccagaaccactgataagggtccaacaaagatcacaaggcaaacggcaaaggcagaaccactgataagggtcaatgttcagtggtgcatgtattgtcttgattaacatcttaaacaacagaaaacagggttgagagcagagaactggtctgaccacaaatttaccagggctgagttttcccaaccctagtaagcctgagggttctgcaggagaccagggcttatctcagtccttatctcaactgcacaagacagacattcccagagtggccgttcatagacttccccccagagatgcattctcttcccagagtattaatattaatattccttgctaggaaaagaatttagtgatatgttgactacttgcatgttcgtttataggccctctgcaagaagaaaaatatgactctttttgcccgaccccacaggcagtcagaaattatggttgtcttcccttgtttcacaaaaatcgctattattctgttctttttcaaggtgcactgatttcatgttgttcaaacacgtgttttacaatcaatttgtacagttaacacaattatcacagtggtcctgaggtgaggtatatcctcagtttatgaagataacaggattaagagattaaagtaaagagaggcaaaagaaattataaaagtattatttgagaactggtaaatgtccatattaaggtgaaatctttacaatttatgttcctctgccttggctgcagccggtccctccacttggggtccctgacttcccgtaacaatgatccttggccccaagggggcaatcagcatagatgtgcaagtacttgtatcccacactgaaatgagaggtatgaagtgacagcatatcttgatctatgtgatggttacatgagttatgacctatttcaaagcttattatgctgtgtgaaaaagaagaaaaccagaggacttgcacaacctgagtttcagactcactctaagctgttataatcaaggcagtgtgcaagtggcattgggagacacaaatacatcaacagactgactttggagacctgaaactgacccacagctataaggttcataggttttttgtttgtttgttaatttctttttgttttctgagacagggtcttactctgtcatccaggctagagtgcagtggcgcgatctcggctcactgcaatctctgcttcccaggctgaagcgatccccgtgcctcagcctcccaggtagctcatactacaggcacatattagtagacatgaggtttctccatgttgcccagactggtctccaactcctgggctcaagtgatccacaggcctcagtctctcatagtgctgggattacagtcatgagccaccatgactggccataggttttcaataaaagcagtttaatggggcaaaggaaatagtttcaattaattgcctttcataaaggagaaggggtagacgaacaaggttatttctccctcacactacacttgaaagtaacttgagacacattatagaccaaaatataaaagccaaagatataaagcatttcgaggatactttgtgacttgttggtagacagagatttattaaatagggcacagaaaaaaatgtataaaggaaaggcttgatacattagacttcatcaaatattagccatatcttctcatcaaaagaggcaacaaagaaagtgaagaaatgagacagcctcagacagggagaaaatagtcacgaaacttatctgacccccaaaccctgtaactataaagtatgctgagatcttcttacctggtaattaaaaca
